(12) United States Patent
Cohen et al.

(10) Patent No.: US 7,189,833 B2
(45) Date of Patent: Mar. 13, 2007

(54) PROSTATE CANCER GENE

(75) Inventors: Daniel Cohen, Neuilly-sur-Seine (FR); Marta Blumenfeld, Paris (FR); Ilya Chumakov, Vaux-le-Penil (FR); Lydie Bougueleret, Vanves (FR)

(73) Assignee: Serono Genetics Institute S.A., Evry (FR)

( * ) Notice: Subject to any disclaimer, the term of this patent is extended or adjusted under 35 U.S.C. 154(b) by 165 days.

(21) Appl. No.: 09/901,484

(22) Filed: Jul. 9, 2001

(65) Prior Publication Data

US 2002/0119460 A1    Aug. 29, 2002

Related U.S. Application Data

(60) Continuation of application No. 09/853,526, filed on May 11, 2001, which is a division of application No. 09/338,907, filed on Jun. 23, 1999, now Pat. No. 6,265,546, which is a continuation-in-part of application No. 09/218,207, filed on Dec. 22, 1998, now Pat. No. 6,346,381, which is a continuation-in-part of application No. 08/996,306, filed on Dec. 22, 1997, now Pat. No. 5,945,522.

(60) Provisional application No. 60/099,658, filed on Sep. 9, 1998.

(51) Int. Cl.
C07H 21/02 (2006.01)

(52) U.S. Cl. .................. 536/23.1; 536/24.3; 536/24.31; 536/24.33; 435/6

(58) Field of Classification Search ................ 536/23.1, 536/24.3, 24.31; 435/6
See application file for complete search history.

(56) References Cited

U.S. PATENT DOCUMENTS 5,807,680 A    9/1998    Sutcliffe et al. ................ 435/6

FOREIGN PATENT DOCUMENTS

| WO | WO 96/20288 | 7/1996 |
| WO | WO 97/36535 | 10/1997 |
| WO | WO 97/46702 | 12/1997 |

OTHER PUBLICATIONS

Schena et al, "Parallel human genome analysis, microarray based expression monitoring of 1000 genes", Proc. Natl. Acad. Science. (1996) 93:10614-10619.*
Capecchi, "Altering the genome by homologous recombination" (Science(1989) 244:1288-1292).*
Genbank Accession No. N39909 (Jan. 22, 1996).*
Genbank Accession No. R96921 (Sep. 11, 1995).*
Genbank Accession No. H061164 (Jun. 21, 1995).*
Gu et al (Proc. Natl. Acad. Sci. (1991) 88:5867-5871).*
Genbank Accession No. M68941 (Apr. 27, 1993).*
Weier et al (Hum. Genet. (1991) 87:489-494).*
Genbank Accession No. AC100813 (Mar. 2003).*
Osoegawa et al (Genomics (1998)52:1-8).*
Genbank Accession No. AC022578.*
Pieter de Jong email (Jun. 12, 2002).*
Genbank Accession No. AC068274 (2005).*
Genbank Accession No. AC009631 (2002).*
adfda
Hillier, L., et al. (1995) y177g12r1 homosapiens cDNA clone 442645. XP 002109141—EMBL Database Entry HS164152, Accession No. H06164.
Kruglyak, L (1997) The use of a genetic map of biallelic markers in linkage studies. Nature Genetics 17(1): 21-24.
Schork, N.J. et al. (1997) Linkage disequiibrum mapping for quantitative traits within case/control setting. American Journal of Human Genetics 61(4) p. A293.
Wang, D., et al. (1996) Toward a third generation genetic map of the human genome based bi-allelic polumorphisms. American Journal of Human Genetics 59(4) p. A03.
Wu, C., et al. (1997) Deletion mapping defines three discrete areas of allelic imbalance on chromosome arm 8p in oral and oropharyngeal squamous cell carcinomas. Genes, Chromosomes & Cancer 20:347-353.
Auttray, et al., "(IMAGE: molecular integration of the analysis of the human genome and its expression)", C R Acad Sci II, 318(2) P. 263-2721 (Feb. 1995).
Ashagbley, et al., "Synthesis of Ether-Linked Analogues of Lysophosphatidate and their Effect on the Proliferation of Human Epithelial Cancer Cells", Anticancer Research, 18(4A) : 181301818 (1996).
Coleman, J., "Characterization of the *Escherichia coli* gene for 1-acyl-sn-glycerol-3-phosphate acyltransferase (*plsC*)", Mol. Gen. Genet. 232(2) :295-303 (1992).

(Continued)

*Primary Examiner*—Jeffrey Fredman
(74) *Attorney, Agent, or Firm*—Saliwanchik, Lloyd & Saliwanchik

(57) ABSTRACT

The present invention relates to PG1, a gene associated with prostate cancer. The invention provides polynucleotides including biallelic markers derived from PG1 and from flanking genomic regions. Primers hybridizing to these biallelic markers and regions flanking are also provided. This invention provides polynucleotides and methods suitable for genotyping a nucleic acid containing sample for one or more biallelic markers of the invention. Further, the invention provides methods to detect a statistical correlation between a biallelic marker allele and prostate cancer and between a haplotype and prostate cancer. The invention also relates to diagnostic methods of determining whether an individual is at risk for developing prostate cancer, and whether an individual suffers from prostate cancer as a result of a mutation in the PG1 gene.

4 Claims, 30 Drawing Sheets

OTHER PUBLICATIONS

Chumakov, et al., "A YAC contig map of the human genome", NATURE, 377 Supp : 175-297 (1995).

Durieux, et al., "Signalling properties of lysophosphatidic acid", Trends in Pharmacol. Sci., 14(6) : 249-254 (1993).

Eberhardt., et al., "Human Lysophosphatidic Acid Acyltransferase", J. Biol. Chem., 272(32) : 20299-20305 (1997).

adad

Faas, et al., "Increased phospholipid fatty acid remodeling in human and rat prostatic adenocarcinoma tissues", J. Urol (Baltimore), 156(1): 243-248 (1996).

Gronwald, et al., "Comparison of DNA Gains and Losses in Primary Ranal Clear Cell Carcinomaa and Metastatic Sites: Importance of 1q and 3p Copy Number Changes in Metastatic Events", Cancer Research, 57(3) : 461-487 (1997).

Gu, et al., "Identification, cloning, and expression of a cytosolic megalaryocyte protein-tyrosine-phosphatase with sequence homology to cytoskeletal protein 4.1", Proc. Natl. Acad. Sci. USA. 88(13)): p. 5867-71 (1991).

Hsuan, et al., "Growth Factor-dependent phosphoinositide Signalling", Int. J. Biochem. Cell. Biol, 29(3) : 415-435 (1997).

Ichikawa, et al., ***Prostate Suppl., 6 : 31-35 (1996).

Kume, et al., "cDNA Cloning and Expression of Murine 1-Acyl-sn-glycerol-3-phosphate Acyltransferase", Biochemical and Biophysical Research Communications, 237(3) : 663-666 (1997).

Levine, et al., "Lysophosphatidic acid: a novel growth and survival factor for renal proximal tubular cells", American Physiological Society, 273(4PT2) : F575-F585 (1997).

Martin, T.F.J., "Phosphoinositides as spatial regulators of membrane traffic", Curr. Opin Neurobiol., 7(3) : 331-338 (1997.

Matsuyama, et al., "Deletion mapping chromosome 8p in prostate cancer by fluorescense in situ hybridization", ONCOGENE, 9(10 :3071-3078(1994).

Nagai, et al., "Comprehensive allelotyping of human hepetocellular carcinoma", Onogene, 14(24) :2927-2933 (1997).

Nagiec et al., "A Suppressor Gene That Enables *Saccharomyces ceravisiae* to Grow without Making Sphingolipids Encodes a Protein That Resembles an *Escherichia coli* Fatty Acyltransferase", Journal of Biological Chemistry, 268(29) : 22156-22163 (1993).

Qi C, et al., "Lysophosphatidic acid stimulates phospholipase D activity and cell proliferation in PC-3 human prostate cancer cells", J. Cell. Physiol. 174(2) : 261-272 (1998).

Scholnick, et al., "Chromosome 8 Allelic Loss and the Outcome of Patients With Squamous Cell Carinoma of the Supraglottic Larynx", Journal of the National Cancer Institute, 88(22) : 1676-1682 (2996).

Sunkara, et al., A novel class of low molecular weight (MW) phospholioirl (PL) signaling inhibitors is selectively cvtotoxi for tumor cells (Meeting abstract) Proc Annu M Sunwoo, et al., "Evidence of Multiple Tumor Suppressor Genes on Chromosome Arm 8p in Supraglottic Laryngeal Cancer", Genes, Chromosomes & Cancer, 16 :167-169 (1996)

Toker, et al., "Signalling through the lipid products of phosphoinositid-3-OH kinase", 387 : 673-676 (1997).

Washburn, et al., "Deletion of loci mapping 8p23-pter in human prostate cancers", Proceedings of the American Association for Cancer Research, 38(#3456) : 515 (Mar. 1997).

Wilson, et al., "2.2 Mb of contiguous nucleotide sequence from chromosome III of C. elegans", NATURE 368(8466): p. 32-38 (1994).

Yaremko, et al., Deletion Mapping Reveals Two Regions of Chromosome 8 Allele Loss in Colorectal Carcinomas, Genes, Chromosomes & Cancer, 10 : 1-6 (1994).

SwissProt: P26647, date Nov. 1, 1998.

SwissProt: P33333, date Nov. 1, 1998.

SwissProt: P38226, date Nov. 1, 1997.

Genbank Accession No. Z29518, date Nov. 12, 1994.

Genbank Accession No. AB005623, date Oct. 6, 1997.

Genbank Accession No. U56417, date Jun. 4, 1997.

Genbank Accession No. U89336, date Feb. 15, 1997.

Genbank Accession No. Z49860, date Jan. 6, 1996.

Genbank Accession No. Z49770, date Aug. 11, 1997.

Genbank Accession No. Z72511, date Sep. 21, 1998.

Genbank Accession No. AF003136, date Dec, 31m 1997.

Search Report listing sequence EMEST7, Accession No. AA280082.

Public Database Chart.

Patented Sequences Database Chart

Bender et al., Genbank Locus Musphkgz, Accession No. L08057, Jun. 1997.

Hillier et al., Genbank Locus AA056643, Accession No. AA056643, Aug. 1995.

dadf dafd

Auffray et al. Genbank Locus HSC2E0111, Accession No. Z44999, Sep. 1995.

Stratagene Catalog, pp. 62-63, 1995.

West et al., "Cloning and expression of two human hysophosphatidic acid acyltransferase cDNA that enhance cytoldne-induced signalling responses in cells", DNA Cell Biol., 16(6) : 691-701 (Jun. 1997).

Chart listing homologous sequences in the GENBANK database, 1 page.

Chart listing homologous sequences in the EMBL Update, EMBL, TREMBL, PRI, and SwissProt database, 10 pages.

\* cited by examiner

HAPLOTYPE FREQUENCY ANALYSIS

| POPULATIONS | AFFECTED CASES 2 (281) 143 SPORADIC CASES +138 FAMILIAL CASES | UNAFFECTED CONTROLS 3 (130) >65 YEARS PSA<4 |
|---|---|---|
| CHARACTERISTICS OF POPULATIONS | 143 SPORADIC CASES +138 FAMILIAL CASES | >65 YEARS PSA<4 |

| MARKERS | 99-123 | 4-26 | 4-14 | 4-77 | 99-217 | 4-67 | 99-213 | 99-221 | 99-135 | HAPLOTYPE FREQUENCIES | | RELATIVE RISK | PVALUE |
|---|---|---|---|---|---|---|---|---|---|---|---|---|---|
| BACS | H0287B09 | B0189E08 | | 11453 | B0463F01 | | | B0725B12 | | CASES (2) | CONTROLS (3) | | |
| CONTIGS | | | | ←――PG1――→ | | | | | | | | | |
| GENES | | | | | | | | | | | | | |
| P VALUE | 2,00E-01 * | 1,00E-01 * | 1,00E-01 * | 2,00E-02 *** | 2,00E-02 ** | 6,00E-04 *** | 9,00E-02 ** | 7,00E-01 | 2,00E-01 * | | | | |
| DISTANCE BETWEEN MARKERS(KB) | <18KB> | <15KB> | <88KB> | <22KB> | <17KB> | <15KB> | <29KB> | >>100KB< | | | | | |
| HAPLOTYPE 8>304KB< | C | A | C | G | T | T | G | A | A | 0,075 | 0,018 | 4,42 | 9,00E-04 *** |
| HAPLOTYPE 7>286KB< | | A | C | G | T | T | G | A | A | 0,095 | 0,016 | 6,46 | 6,00E-05 **** |
| HAPLOTYPE 6<186KB> | | A | C | G | T | T | G | A | | 0,116 | 0,019 | 6,78 | 1,00E-05 ***** |
| HAPLOTYPE 5<171KB> | | | C | G | T | T | G | A | | 0,117 | 0,013 | 10,06 | 9,00E-07 ****** |
| HAPLOTYPE 4<83KB> | | | | G | T | T | G | A | | 0,117 | 0,025 | 5,17 | 2,00E-05 ***** |
| HAPLOTYPE 3.1<54KB> | | | | | T | T | G | A | | 0,117 | 0,027 | 4,78 | 2,00E-05 ***** |
| HAPLOTYPE 3.2<54KB> | | | | G | T | T | G | | | 0,222 | 0,109 | 2,33 | 4,00E-05 ***** |
| HAPLOTYPE 2.2<39KB> | | | | G | T | T | G | | | 0,251 | 0,134 | 2,17 | 2,00E-04 **** |
| HAPLOTYPE 2<32KB> | | | | | T | T | G | | | 0,226 | 0,112 | 2,32 | 1,00E-04 **** |
| HAPLOTYPE 1.1<17KB> | | | | | T | T | | | | 0,256 | 0,146 | 2,01 | 3,00E-04 **** |
| HAPLOTYPE 1.2<15KB> | | | | | | T | G | | | 0,233 | 0,129 | 2,05 | 6,00E-04 *** |

FIG.4

| BAC | MARKER | SEQ ID N° | SEQ ID N°(MUT) | PU SEQUENCE | SEQ ID N° | RP SEQUENCE | SEQ ID N° | POLYMORPHISM POSITION* | BASE | MICROSEQ. OLIGOS POSITIONS* | |
|---|---|---|---|---|---|---|---|---|---|---|---|
| 228 | 99-123 | 21 | 30 | AAAGCCCAGGACTAGAAGG | 39 | TATTCAGAAAGGAGTGGG | 48 | 24 | C/T | 1-23 | 25-47 (COMPLEMENTARY) |
| 189 | 4-26 | 22 | 31 | TACAGCCCTGTAAGACAC | 40 | TGAGGACTGCTAGGAAAG | 49 | 24 | A/G | 1-23 | 25-47 (COMPLEMENTARY) |
| 228/189 | 4-14 | 23 | 32 | TCTAACCTCTCATCCAAC | 41 | GACTGTATCCTTGATGCAC | 50 | 24 | C/T | 1-23 | 25-47 (COMPLEMENTARY) |
| 189/463 | 4-77 | 24 | 33 | TGTTGATTTACAGGCGGC | 42 | GGAAAGGTACTCATTCATAG | 51 | 24 | G/C | 1-23 | 25-47 (COMPLEMENTARY) |
| 463 | 99-217 | 25 | 34 | GGTGGGAATTTACTATATG | 43 | GTTATTTGTGTGAGCTTTG | 52 | 24 | C/T | 1-23 | 25-47 (COMPLEMENTARY) |
| 189/463 | 4-67 | 26 | 35 | AAGTTCACCTTCTCAAGC | 44 | TGAAAGAGTTTATTTCTCTGG | 53 | 24 | C/T | 1-23 | 25-47 (COMPLEMENTARY) |
| 463 | 99-213 | 27 | 36 | ATACTGGCAGCGTGTGCTTC | 45 | TTATTGCCCCACATGCTTGAG | 54 | 24 | C/T | 1-23 | 25-47 (COMPLEMENTARY) |
| 463 | 99-221 | 28 | 37 | CCCTTTTTCTTCACTGTTC | 46 | TCATTCGTCTGGCTAGGTC | 55 | 24 | A/C | 1-23 | 25-47 (COMPLEMENTARY) |
| 725 | 99-135 | 29 | 38 | TGGAAGTTGTTATTGCCC | 47 | AAACACCTCCCATTGTGC | 56 | 24 | A/G | 1-23 | 25-47 (COMPLEMENTARY) |

FIG.6A

*: POSITIONS ARE GIVEN RELATIVE TO THE SEQUENCE OF THE CORRESPONDING MARKER (i.e. SEQ ID N°21-38 AND 57-62)

| BAC | MARKER | SEQ ID N° | SEQ ID N°(MUT) | PU SEQUENCE | SEQ ID N° | RP SEQUENCE | SEQ ID N° | POLYMORPHISM POSITION* | BASE | MICROSEQ. OLIGOS POSITIONS* | |
|---|---|---|---|---|---|---|---|---|---|---|---|
| 189/463 | 99-148 | 57 | 60 | ATCAAATCAGTGAAGTCTGAG | 63 | ACAAATCTATATAAGGCTGG | 66 | 24 | A/C | 1-23 | 25-47 (COMPLEMENTARY) |
| 463 | 4-73 | 58 | 61 | ATCCGTGGAACATTCTGG | 64 | CTCTTGGTTGAAACAGCAGTG | 67 | 24 | G/C | 1-23 | 25-47 (COMPLEMENTARY) |
| 463 | 4-65 | 59 | 62 | GATTTAAGCTACGCTATTAG | 65 | TGGCTCTGCATTTCTTCC | 68 | 24 | C/T | 1-23 | 25-47 (COMPLEMENTARY) |

FIG.6B

*: POSITIONS ARE GIVEN RELATIVE TO THE SEQUENCE OF THE CORRESPONDING MARKER (i.e. SEQ ID N°21-38 AND 57-62)

| EXON Phase | START | END | 5' SPsite | PHASE | 3' SPsite |
|---|---|---|---|---|---|
| Ex1 +0 | 2001 | 2216 | | | GTGAGC |
| Ex2 +1 | 18196 | 18265 | TAG | +0 | GTTTGTA |
| Ex3 +0 | 23717 | 23832 | CAG | +2 | GTAACT |
| Ex4 +0 | 25571 | 25660 | CAG | +0 | GTAAGA |
| Ex5 +2 | 34669 | 34759 | CAG | +0 | GTAAGT |
| Ex6 +1 | 40688 | 40846 | TAG | +1 | GTAAGT |
| Ex7 +2 | 48070 | 48193 | TAG | +2 | GTGAGT |
| Ex8 | 50182 | 54523 | TAG | +1 | |
| ATG codon | 2031 | 2033 | | | |
| STOP codon | 50405 | 50407 | | | |
| POLY Ad site | 54445 | 54450 | | | |

FIG. 7

|  |  | box 1 | box 2 | box 3 |
|---|---|---|---|---|
| PG1 | Hs | NHQ *81-83* | FPEGTR *160-165* | LDAIYDVTV *211-219* |
| AF003136 (Genbank) | Ce | NHQ *630-632* | FPEGTR *712-717* | LDAIYDVTV *762-770* |
| Z72511 (Genbank) | Ce | 48 NHR 50 | FPEGTD *129-134* | VEYIYDITI *204-212* |
| P38226 (Swissport) | Sc | 111 NHQ 113 | FPEGTN *223-228* | IESLYDITI *271-279* |
| P33333 (Swissport) | Sc | 81 NHQ 83 | FPEGTR *154-159* | - |
| Z49770 (Genbank) | Sc | 116 NHQ 118 | FPEGTN *215-220* | LDAIYDVTI *265-273* |
| P26647 (Swissport) | Ec | 72 NHQ 74 | FPEGTR *145-150* | - |
| Z49860 (Genbank) | Bn | - | FVEGTR *90-95* | VPAIYDMTV *138-146* |
| U89336 (Genbank) | Hs | 95 NHQ 97 | FPEGTR *168-173* | - |
| U56417 (Genbank) | Hs | 103 NHQ 105 | FPEGTR *176-181* | - |
| AB005623 (Genbank) | Mm | 100 NHQ 102 | FPEGTR *173-178* | |
| Z29518 (Genbank) | Zm | 91 NHR 93 | FVEGTR *170-175* | VPAIYDTTV *218-226* |

Hs = Homo sapiens, Ce = Caenorabibitis elegans, Ec = Escherichia coli;
Sc = Saccharomyces cerevisiae, Bn = Brassica napus, Zm = Zea maize,
Mm = Mus Musculus

- = pattern absent from protein sequence

Note: Funcitional acyl glycerol transferases all contain boxes 1 and 2 and not box 3. Proteins most related to PG1 contain the 3 boxes with a high degree of conservation.

*FIG. 9*

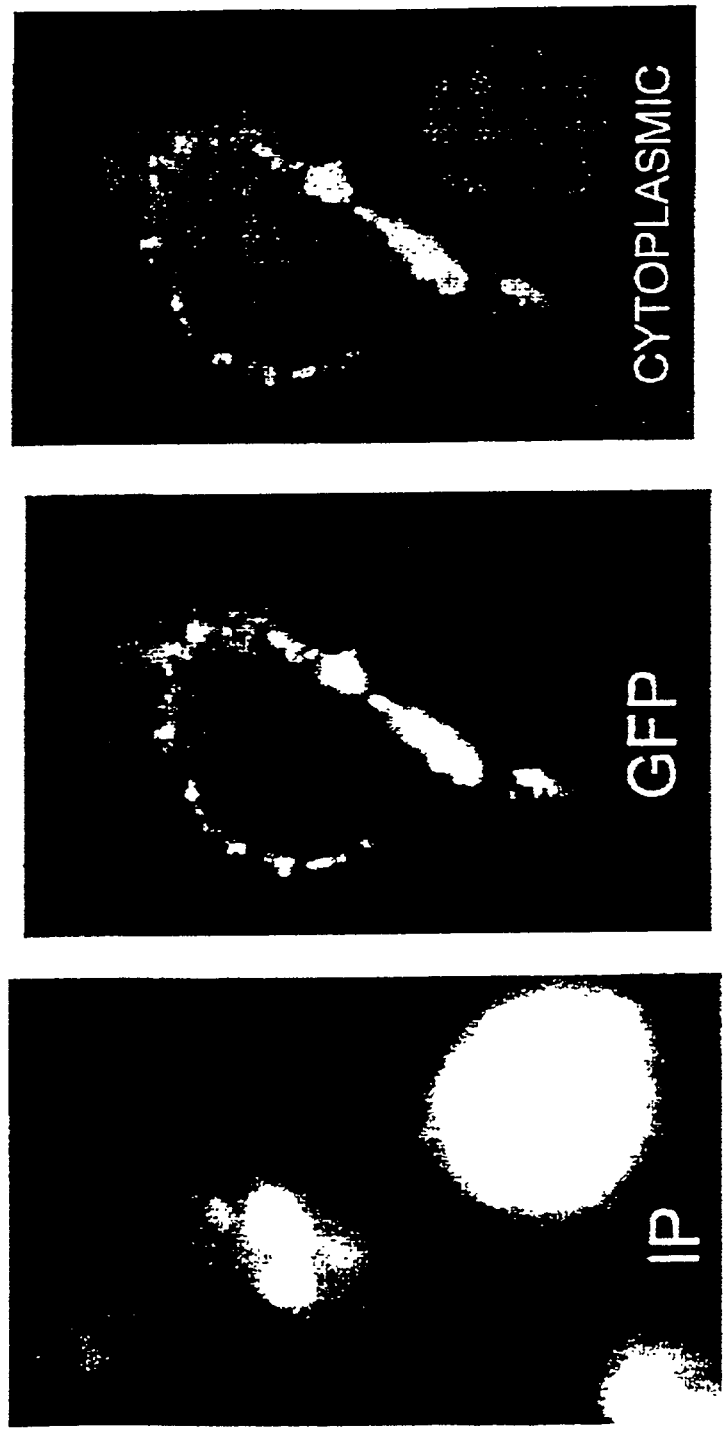

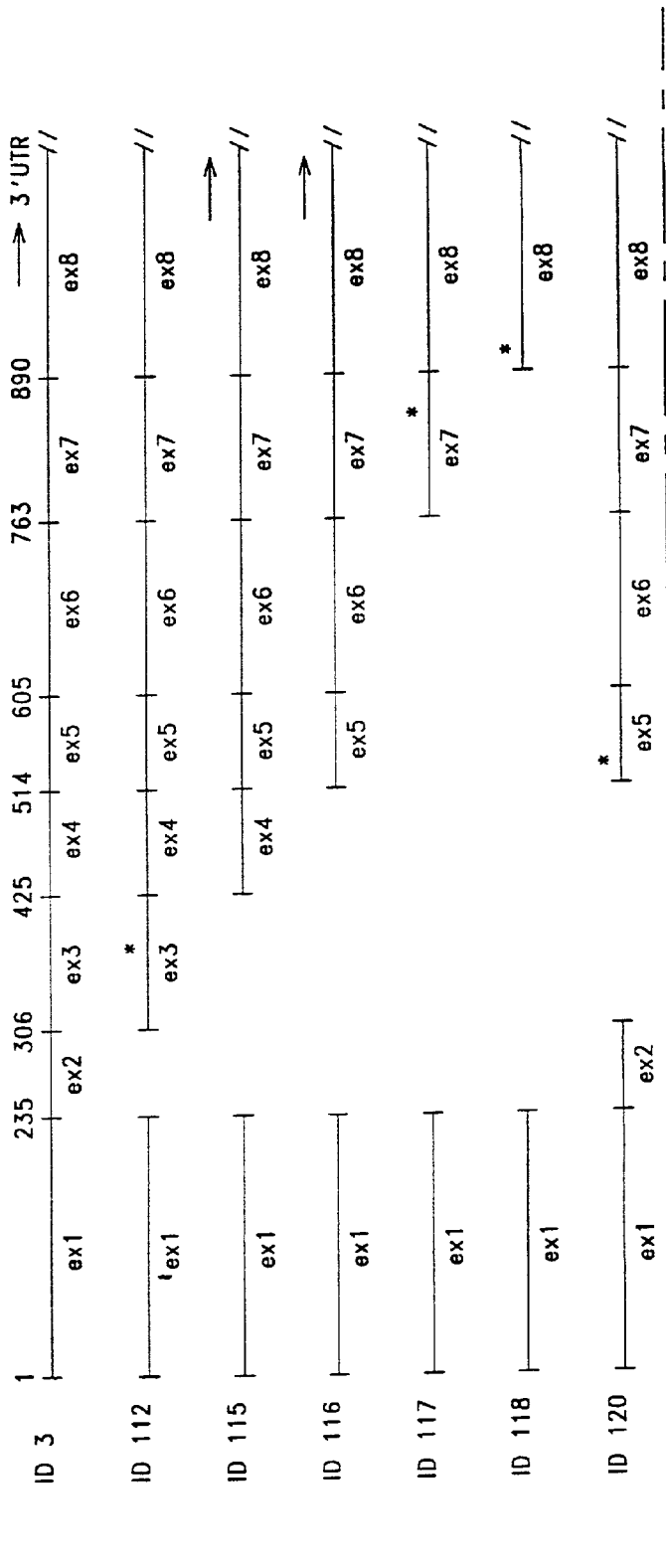

FIG. 15

| name of markers | PG1 | Polym. | Freq(cas) | Freq(controls) | abs diff % (fq(cases)− (fq(controls))) | Odd Ratio | Pvalue | Freq(randoms) | Attributable Risk |
|---|---|---|---|---|---|---|---|---|---|
| 99-1485/251 | prom | G*/T | 0.32 | 0.24 | 7.4 | 1.44 | 2.53E-02 | 0.29 | 17.58 |
| 99-622/95 | In1 | G/T | 0.52 | 0.42 | 10.1 | 1.51 | 9.64E-03 | ND$ | ND |
| 99-619/141 | in1 | C/T | 0.28 | 0.22 | 5.8 | 1.37 | 6.93E-02 | ND | ND |
| 4-76/222 | in1 | G/A | 0.43 | 0.38 | 5 | 1.23 | 1.57E-01 | 0.41 | 13.15 |
| 4-77/151 | in1 | G/C | 0.34 | 0.26 | 7.4 | 1.43 | 1.35E-02 | 0.31 | 18.16 |
| 4-71/233 | in1 | A/G | 0.34 | 0.26 | 8.3 | 1.49 | 1.43E-02 | 0.28 | 18.64 |
| 4-72/127 | in1 | A/G | 0.36 | 0.30 | 5.7 | 1.29 | 9.43E-02 | 0.31 | 13.25 |
| 4-73/134 | in1 | G/C | 0.52 | 0.42 | 9.7 | 1.48 | 7.29E-03 | 0.52 | 26.76 |
| 99-610/250 | in1 | G/A | 0.43 | 0.37 | 6.2 | 1.30 | 8.33E-02 | ND | ND |
| 99-609/225 | in1 | A/T | 0.37 | 0.30 | 7 | 1.36 | 4.83E-02 | ND | ND |
| 4-90/283 | in2 | A/C | 0.29 | 0.25 | 4.4 | 1.25 | 1.68E-01 | 0.28 | 9.32 |
| 99-602/258 | in2 | A/G | 0.33 | 0.25 | 7.4 | 1.44 | 2.69E-02 | ND | ND |
| 99-600/492 | in3 | T/A | 0.34 | 0.34 | 0.3 | 1.01 | 7.52E-01 | ND | ND |
| 99-598/130 | in4 | G/A | 0.35 | 0.25 | 9.2 | 1.55 | 7.29E-03 | ND | ND |
| 99-217/277 | in4 | T/C | 0.31 | 0.28 | 3.8 | 1.20 | 1.07E-01 | 0.28 | 8.46 |
| 99-576/421 | in6 | G/C | 0.27 | 0.17 | 9.2 | 1.72 | 3.18E-03 | 0.24 | 18.40 |
| 4-61/269 | 3'UTR | G/A | 0.01 | 0.00 | 0.3 | 1.76 | 0,527 § | ND | ND |
| 4-66/145 | 3'UTR | C/T | 0.25 | 0.19 | 6.2 | 1.43 | 4.68E-03 | 0.24 | 13.16 |
| 4-67/40 | 3'UTR | T/C | 0.25 | 0.20 | 4.9 | 1.33 | 2.39E-02 | 0.24 | 10.97 |

§ Test Fisher—$ ND: Not done —* disease associated allele / not associated allele

FIG. 18B

FIG. 19A    HAPLOTYPE FREQUENCY ANALYSIS

| POPULATIONS | AFFECTED | UNAFFECTED |
|---|---|---|
| sample sizes | CASES (n=491) | CONTROLS (n=317) |
| characteristics of populations | 294 sporadic cases + 197 familial cases | 28 unaffected (65 years or older) + 289 controls (65 years or older with PSA<4) |

| PG1 (8p23) | | | 4-14/240 | 99-217/277 | 4-66/145 | 99-221/377 |
|---|---|---|---|---|---|---|
| | | | | in4 | 3'UTR | |
| distance between mks | | | <100kb> | <17kb> | <43kb> | |
| size (cases vs controls) | | | 481 vs 305 | 481 vs 302 | 481 vs 300 | 481 vs 303 |
| frequency % (cases/controls) | | | 65,7/62,1(C) | 31,3/27,5(C) | 25,1/19(C) | 42,7/42,91(A) |
| abs diff freq. all.(cases-controls) | | | 3.6 | 3.8 | 6.2 | 0 |
| pvalue | | | 1.47E-01 | 1.07E-01 | 4.68E-03 | 7.52E-01 |
| Hardy Weindeberg Disequilibrium | cases | | 5.84E-01 | 6.55E-01 | 2.54E-01 | 5.84E-01 |
| | controls | | 4.80E-01 | 2.21E-01 | 3.71E-01 | 2.54E-01 |
| HAP 1 <43kb> | | 451 vs 297 | | | C | A |
| HAP 2 <17kb> | | 451 vs 296 | | T | C | |
| HAP 3 <117kb> | | 452 vs 299 | C | | C | |
| HAP 4 <100kb> | | 479 vs 302 | C | T | | |
| HAP 5 <60kb> | | 476 vs 300 | | T | | A |
| HAP 6 <160kb> | PT2 | 476 vs 303 | C | | | C |
| HAP 7 <160kb> | | 447 vs 297 | C | | C | A |
| HAP 8 <60kb> | | 446 vs 294 | | T | C | A |
| HAP 9 <117kb> | | 450 vs 296 | C | T | C | |
| HAP 10 <160kb> | PT3 | 474 vs 300 | C | T | | A |
| HAP 11 <160kb> | PT4 | 445 vs 294 | C | T | C | A |

| haplotype frequencies | | Odd ratio | Chi-S | Pvalue | |
|---|---|---|---|---|---|
| cases | controls | | | | |
| 0.116 | 0.067 | 1.83 | 9.85 | (1.7e-03) | *** |
| 0.243 | 0.183 | 1.43 | 7.49 | (6.2e-03) | ** |
| 0.182 | 0.130 | 1.49 | 7.18 | (7.3e-03) | ** |
| 0.217 | 0.188 | 1.20 | 1.88 | (1.7e-01) | * |
| 0.155 | 0.132 | 1.20 | 1.54 | (2.1e-01) | * |
| 0.373 | 0.346 | 1.12 | 1.16 | (2.7e-01) | * |
| 0.095 | 0.042 | 2.39 | 14.62 | (1.3e-04) | **** |
| 0.117 | 0.065 | 1.93 | 11.33 | (7.3e-04) | *** |
| 0.178 | 0.125 | 1.53 | 7.80 | (5.2e-03) | ** |
| 0.114 | 0.089 | 1.32 | 2.44 | (1.1e-01) | * |
| 0.095 | 0.032 | 3.18 | 21.59 | (3.4e-06) | ***** |

FIG. 19B  HAPLOTYPE FREQUENCY ANALYSIS
PG1 (8p23)

| markers of haplotype Max | 4-14/240 | 99-217/277 In4 | 4-66/145 3'UTR | 99-221/377 |
|---|---|---|---|---|
| | C | T | C | A |
| distance between mks | <100kb> | <17kb> | <43kb> | |

| PG1 | sample sizes cases vs control | haplotype frequencies cases | haplotype frequencies controls | odd ratio | chi-S | P value | |
|---|---|---|---|---|---|---|---|
| cases vs control | 455 vs 294 | 0.095 | 0.032 | 3.18 | 21.59 | 3.40E-06 | ****** |
| cases (<=65 years) vs controls | 171 vs 294 | 0.105 | 0.032 | 3.56 | 20.91 | 4.60E-06 | ****** |
| cases (>65 years) vs control | 271 vs 294 | 0.079 | 0.032 | 2.60 | 12.13 | 4.80E-04 | **** |
| sporadic cases vs controls | 266 vs 294 | 0.096 | 0.032 | 3.23 | 19.73 | 8.60E-06 | ****** |
| sporadic cases (<=65 years) vs controls | 85 vs 294 | 0.095 | 0.032 | 3.20 | 12.04 | 5.00E-04 | **** |
| sporadic cases (>65 years) vs controls | 178 vs 294 | 0.085 | 0.032 | 2.82 | 12.75 | 3.50E-04 | **** |
| *informative sporadic cases vs controls* | 67 vs 294 | 0.062 | 0.032 | 2.00 | 2.70 | 9.40E-02 | ** |
| familial cases vs controls | 179 vs 294 | 0.098 | 0.032 | 3.32 | 18.33 | 1.80E-05 | ***** |
| familial cases (<=65 years) vs controls | 86 vs 294 | 0.112 | 0.032 | 3.83 | 17.98 | 2.20E-05 | ***** |
| familial cases (>65 years) vs controls | 93 vs 294 | 0.075 | 0.032 | 2.48 | 6.59 | 1.00E-02 | ** |
| *familial cases (>=3 caP) vs controls* | 79 vs 294 | 0.123 | 0.032 | 4.26 | 21.33 | 3.70E-06 | ****** |

FIG. 20    HAPLOTYPE FREQUENCY ANALYSIS (PG1)

| Markers in PG1 | | 99-622/95 | 4-77/151 | 4-71/233 | 4-73/134 | 99-598/130 | 99-576/421 | 4-66/145 | haplotype frequencies | | Odd Ratio | Attributable Risk % | Pvalue (cases vs controls) |
|---|---|---|---|---|---|---|---|---|---|---|---|---|---|
| | | G/T | C/G | A/G | C/G | A/G | C/G | C/T | cases | controls | | | |
| | | | In1 | In1 | In1 | In4 | In6 | 3'UTR | | | | | |
| size (cases vs controls) | | 336 vs 108 | 363 vs 173 | 336 vs 130 | 352 vs 129 | 347 vs 126 | 355 vs 129 | 456 vs 306 | | | | | |
| allelic frequency % (cases / controls) | | 52/42 (G) | 34/26 (G) | 34/26 (A) | 52/42 (G) | 35/25 (G) | 27/17 (G) | 25/19 (C) | | | | | |
| allelic frequency % (randoms) | | ND | 31 (G) | 26 (A) | 52 (G) | ND | 24 (G) | 24 (C) | | | | | |
| diff freq. all. % (cases -controls) | | 10.1 | 7.4 | 8.3 | 9.7 | 9.2 | 9.2 | 6.2 | | | | | |
| pvalue (cases vs controls) | | 9.64E-03 | 1.35E-02 | 1.43E-02 | 7.29E-03 | 7.29E-03 | 3.18E-03 | 4.68E-03 | | | | | |
| Odd Ratio | | 1.51 | 1.43 | 1.49 | 1.46 | 1.55 | 1.72 | 1.43 | | | | | |
| Attributable Risk % | | ND | 18.16 | 18.64 | 26.76 | ND | 8.46 | 13.16 | | | | | |
| Hardy Weindeberg Disequilibrium | cases | 7.52E-01 | 7.52E-01 | 5.84E-01 | 7.52E-01 | 7.52E-01 | 7.52E-01 | 3.43E-01 | | | | | |
| | controls | 4.39E-01 | 4.03E-01 | 1.21E-01 | 7.52E-01 | 6.52E-02 | 7.52E-01 | 1.29E-01 | | | | | |
| haplotype 1 | 2 MKS | 339 vs 167 | G | | | | | | | 0.263 | 0.152 | 1.99 | 18.55 | (6.7e-05) |
| haplotype 2 | 3 MKS | 330 vs 122 | G | G | | | | | | 0.259 | 0.147 | 2.02 | ND | (3.9e-04) |
| haplotype 3 | 4 MKS | 312 vs 122 | G | G | A | | | | | 0.259 | 0.147 | 2.02 | ND | (4.1e-04) |
| haplotype 4 | 5 MKS | 311 vs 121 | G | G | A | G | | | | 0.26 | 0.148 | 2.01 | ND | (4.8e-04) |
| haplotype 5 | 6 MKS | 309 vs 121 | G | G | A | G | G | | | 0.258 | 0.149 | 2 | ND | (5.3e-04) |
| haplotype 6 | 7 MKS | 290 vs 99 | G | G | A | G | G | G | | 0.255 | 0.146 | 2 | ND | (1.6e-03) |

ND: Not Done

PROSTATE CANCER GENE

RELATED APPLICATION DATA

This application is a divisional of U.S. patent application Ser. No. 09/338,907, filed Jun. 23, 1999, now U.S. Pat. No. 6,265,546, which is a continuation-in-part of U.S. patent application Ser. No. 09/218,207, filed Dec. 22, 1998, now U.S. Pat. No. 6,346,381, which is a continuation-in-part of U.S. patent application Ser. No. 08/996,306, filed Dec. 22, 1997, now U.S. Pat. No. 5,945,522, and claims priority from U.S. Provisional Patent Application Ser. No. 60/099,658, filed Sep. 9, 1998. This application is also a continuation of U.S. Ser. No. 09/853,526, filed May 11, 2001, pending. The disclosures of each of the above-identified applications are incorporated herein by reference in their entireties, including all figures, tables, and nucleic acid/amino acid sequences.

The Sequence listing for this application is on duplicate compact discs labeled "Copy 1" and "Copy 2." Copy 1 and Copy 2 each contain only one file named "GEN-T111XC3D2.ST25.tx" which was created on Feb. 19, 2002, and is 608 KB. The entire contents of each of the computer discs are incorporated herein by reference in their entireties.

BACKGROUND OF THE INVENTION

A cancer is a clonal proliferation of cells produced as a consequence of cumulative genetic damage that finally results in unrestrained cell growth, tissue invasion and metastasis (cell transformation). Regardless of the type of cancer, transformed cells carry damaged DNA in many forms: as gross chromosomal translocations or, more subtly, as DNA amplification, rearrangement or even point mutations.

Some oncogenic mutations is inherited in the germline, thus predisposing the mutation carrier to an increased risk of cancer. However, in a majority of cases, cancer does not occur as a simple monogenic disease with clear Mendelian inheritance. There is only a two- or threefold increased risk of cancer among first-degree relatives for many cancers (Mulvihill J J, Miller R W & Fraumeni J F, 1977, Genetics of human cancer Vol 3, New York Raven Press). Alternatively, DNA damage is acquired somatically, probably induced by exposure to environmental carcinogens. Somatic mutations are generally responsible for the vast majority of cancer cases.

Studies of the age dependence of cancer have suggested that several successive mutations are needed to convert a normal cell into an invasive carcinoma. Since human mutation rates are typically $10^{-6}$/gene/cell, the chance of a single cell undergoing many independent mutations is very low (Loeb L A, Cancer Res 1991, 51: 3075–3079). Cancer nevertheless happens because of a combination of two mechanisms. Some mutations enhance cell proliferation, increasing the target population of cells for the next mutation. Other mutations affect the stability of the entire genome, increasing the overall mutation rate, as in the case of mismatch repair proteins (reviewed in Arnheim N & Shibata D, Curr. Op. Genetics & Development, 1997, 7:364–370).

An intricate process known as the cell cycle drives normal proliferation of cells in an organism. Regulation of the extent of cell cycle activity and the orderly execution of sequential steps within the cycle ensure the normal development and homeostasis of the organism. Conversely, many of the properties of cancer cells—uncontrolled proliferation, increased mutation rate, abnormal translocations and gene amplifications—can be attributed directly to perturbations of the normal regulation or progression of the cycle. In fact, many of the genes that have been identified over the past several decades as being involved in cancer, can now be appreciated in terms of their direct or indirect role in either regulating entry into the cell cycle or coordinating events within the cell cycle.

Recent studies have identified three groups of genes which are frequently mutated in cancer. The first group of genes, called oncogenes, are genes whose products activate cell proliferation. The normal non-mutant versions are called protooncogenes. The mutated forms are excessively or inappropriately active in promoting cell proliferation, and act in the cell in a dominant way in that a single mutant allele is enough to affect the cell phenotype. Activated oncogenes are rarely transmitted as germline mutations since they may probably be lethal when expressed in all the cells. Therefore oncogenes can only be investigated in tumor tissues.

Oncogenes and protooncogenes can be classified into several different categories according to their function. This classification includes genes that code for proteins involved in signal transduction such as: growth factors (i.e., sis, int-2); receptor and non-receptor protein-tyrosine kinases (i.e., erbB, src, bcr-abl, met, trk); membrane-associated G proteins (i.e., ras); cytoplasmic protein kinases (i.e., mitogen-activated protein kinase—MAPK—family, raf, mos, pak), or nuclear transcription factors (i.e., myc, myb, fos, jun, rel) (for review see Hunter T, 1991 Cell 64:249; Fanger G R et al., 1997 Curr. Op. Genet. Dev. 7:67–74; Weiss F U et al., ibid. 80–86).

The second group of genes which are frequently mutated in cancer, called tumor suppressor genes, are genes whose products inhibit cell growth. Mutant versions in cancer cells have lost their normal function, and act in the cell in a recessive way in that both copies of the gene must be inactivated in order to change the cell phenotype. Most importantly, the tumor phenotype can be rescued by the wild type allele, as shown by cell fusion experiments first described by Harris and colleagues (Harris H et al.,1969, Nature 223:363–368). Germline mutations of tumor suppressor genes is transmitted and thus studied in both constitutional and tumor DNA from familial or sporadic cases. The current family of tumor suppressors includes DNA-binding transcription factors (i.e., p53, WT1), transcription regulators (i.e., RB, APC, probably BRCA1), protein kinase inhibitors (i.e., p16), among others (for review, see Haber D & Harlow E, 1997, Nature Genet. 16:320–322).

The third group of genes which are frequently mutated in cancer, called mutator genes, are responsible for maintaining genome integrity and/or low mutation rates. Loss of function of both alleles increase cell mutation rates, and as consequence, proto-oncogenes and tumor suppressor genes is mutated. Mutator genes can also be classified as tumor suppressor genes, except for the fact that tumorigenesis caused by this class of genes cannot be suppressed simply by restoration of a wild-type allele, as described above. Genes whose inactivation may lead to a mutator phenotype include mismatch repair genes (i.e., MLH1, MSH2), DNA helicases (i.e., BLM, WRN) or other genes involved in DNA repair and genomic stability (i.e., p53, possibly BRCA1 and BRCA2) (For review see Haber D & Harlow E, 1997, Nature Genet. 16:320–322; Fishel R & Wilson T. 1997, Curr. Op. Genet. Dev. 7: 105–113; Ellis N A, 1997 ibid. 354–363).

The recent development of sophisticated techniques for genetic mapping has resulted in an ever expanding list of genes associated with particular types of human cancers. The human haploid genome contains an estimated 80,000 to 100,000 genes scattered on a 3×10⁹ base-long double-stranded DNA. Each human being is diploid, i.e., possesses two haploid genomes, one from paternal origin, the other from maternal origin. The sequence of a given genetic locus may vary between individuals in a population or between the two copies of the locus on the chromosomes of a single individual. Genetic mapping techniques often exploit these differences, which are called polymorphisms, to map the location of genes associated with human phenotypes.

One mapping technique, called the loss of heterozygosity (LOH) technique, is often employed to detect genes in which a loss of function results in a cancer, such as the tumor suppressor genes described above. Tumor suppressor genes often produce cancer via a two hit mechanism in which a first mutation, such as a point mutation (or a small deletion or insertion) inactivates one allele of the tumor suppressor gene. Often, this first mutation is inherited from generation to generation.

A second mutation, often a spontaneous somatic mutation such as a deletion which deletes all or part of the chromosome carrying the other copy of the tumor suppressor gene, results in a cell in which both copies of the tumor suppressor gene are inactive.

As a consequence of the deletion in the tumor suppressor gene, one allele is lost for any genetic marker located close to the tumor suppressor gene. Thus, if the patient is heterozygous for a marker, the tumor tissue loses heterozygosity, becoming homozygous or hemizygous. This loss of heterozygosity generally provides strong evidence for the existence of a tumor suppressor gene in the lost region.

By genotyping pairs of blood and tumor samples from affected individuals with a set of highly polymorphic genetic markers, such as microsatellites, covering the whole genome, one can discover candidate locations for tumor suppressor genes. Due to the presence of contaminant non-tumor tissue in most pathological tumor samples, a decreased relative intensity rather than total loss of heterozygosity of informative microsatellites is observed in the tumor samples. Therefore, classic LOH analysis generally requires quantitative PCR analysis, often limiting the power of detection of this technique. Another limitation of LOH studies resides on the fact that they only allow the definition of rather large candidate regions, typically spanning over several megabases. Refinement of such candidate regions requires the definition of the minimally overlapping portion of LOH regions identified in tumor tissues from several hundreds of affected patients.

Another approach to genetic mapping, called linkage analysis, is based upon establishing a correlation between the transmission of genetic markers and that of a specific trait throughout generations within a family. In this approach, all members of a series of affected families are genotyped with a few hundred markers, typically microsatellite markers, which are distributed at an average density of one every 10 Mb. By comparing genotypes in all family members, one can attribute sets of alleles to parental haploid genomes (haplotyping or phase determination). The origin of recombined fragments is then determined in the offspring of all families. Those that co-segregate with the trait are tracked. After pooling data from all families, statistical methods are used to determine the likelihood that the marker and the trait are segregating independently in all families. As a result of the statistical analysis, one or several regions are selected as candidates, based on their high probability to carry a trait causing allele. The result of linkage analysis is considered as significant when the chance of independent segregation is lower than 1 in 1000 (expressed as a LOD score>3). Identification of recombinant individuals using additional markers allows further delineation of the candidate linked region, which most usually ranges from 2 to 20 Mb.

Linkage analysis studies have generally relied on the use of microsatellite markers (also called simple tandem repeat polymorphisms, or simple sequence length polymorphisms). These include small arrays of tandem repeats of simple sequences (di- tri- tetra-nucleotide repeats), which exhibit a high degree of length polymorphism, and thus a high level of informativeness. To date, only just more than 5,000 microsatellites have been ordered along the human genome (Dib et al., Nature 1996, 380: 152), thus limiting the maximum attainable resolution of linkage analysis to ca. 600 kb on average.

Linkage analysis has been successfully applied to map simple genetic traits that show clear Mendelian inheritance patterns. About 100 pathological trait-causing genes were discovered by linkage analysis over the last 10 years.

However, linkage analysis approaches have proven difficult for complex genetic traits, those probably due to the combined action of multiple genes and/or environmental factors. In such cases, too large an effort and cost are needed to recruit the adequate number of affected families required for applying linkage analysis to these situations, as recently discussed by Risch, N. and Merikangas, K. (Science 1996, 273: 1516–1517). Finally, linkage analysis cannot be applied to the study of traits for which no available large informative families are available. Typically, this will be the case in any attempt to identify trait-causing alleles involved in sporadic cases.

The incidence of prostate cancer has dramatically increased over the last decades. It averages 30–50/100,000 males both in Western European countries as well as within the US White male population. In these countries, it has recently become the most commonly diagnosed malignancy, being one of every four cancers diagnosed in American males. Prostate cancer's incidence is very much population specific, since it varies from 2/100,000 in China, to over 80/100,000 among African-American males.

In France, the incidence of prostate cancer is 35/100,000 males and it is increasing by 10/100,000 per decade. Mortality due to prostate cancer is also growing accordingly. It is the second cause of cancer death among French males, and the first one among French males aged over 70. This makes prostate cancer a serious burden in terms of public health, especially in view of the aging of populations.

An average 40% reduction in life expectancy affects males with prostate cancer. If completely localized, prostate cancer can be cured by surgery, with however an average success rate of only ca. 50%. If diagnosed after metastasis from the prostate, prostate cancer is a fatal disease for which there is no curative treatment.

Early-stage diagnosis relies on Prostate Specific Antigen (PSA) dosage, and would allow the detection of prostate cancer seven years before clinical symptoms become apparent. The effectiveness of PSA dosage diagnosis is however limited, due to its inability to discriminate between malignant and non-malignant affections of the organ.

Therefore, there is a strong need for both a reliable diagnostic procedure which would enable early-stage prostate cancer prognosis, and for preventive and curative treatments of the disease. The present invention relates to the PG1 gene, a gene associated with prostate cancer, as well as diagnostic methods and reagents for detecting alleles of the gene which may cause prostate cancer, and therapies for treating prostate cancer.

SUMMARY OF THE INVENTION

The present invention relates to the identification of a gene associated with prostate cancer, identified as the PG1 gene, and reagents, diagnostics, and therapies related thereto. The present invention is also based on the discovery of a novel set of PG1-related biallelic markers. See the definition of PG1-related biallelic markers in the Detailed Description Section. These markers are located in the coding regions as well as non-coding regions adjacent to the PG1 gene. The position of these markers and knowledge of the surrounding sequence has been used to design polynucleotide compositions which are useful in determining the identity of nucleotides at the marker position, as well as more complex association and haplotyping studies which are useful in determining the genetic basis for diseases including cancer and prostate cancer. In addition, the compositions and methods of the invention find use in the identification of the targets for the development of pharmaceutical agents and diagnostic methods, as well as the characterization of the differential efficacious responses to and side effects from pharmaceutical agents acting on diseases including cancer and prostate cancer.

A first embodiment of the invention is a recombinant, purified or isolated polynucleotide comprising, or consisting of a mammalian genomic sequence, gene, or fragments thereof. In one aspect the sequence is derived from a human, mouse or other mammal. In a preferred aspect, the genomic sequence is the human genomic sequence of SEQ ID NO: 179 or the complement thereto. In a second preferred aspect, the genomic sequence is selected from one of the two mouse genomic fragments of SEQ ID NO: 182 and 183. In yet another aspect of this embodiment, the nucleic acid comprises nucleotides 1629 through 1870 of the sequence of SEQ ID NO: 179. Optionally, said polynucleotide consists of, consists essentially of, or comprises a contiguous span of nucleotides of a mammalian genomic sequence, preferably a sequence selected the following SEQ ID NOs: 179, 182, and 183, wherein said contiguous span is at least 6, 8, 10, 12, 15, 20, 25, 30, 50, 100, 200, or 500 nucleotides in length.

A second embodiment of the present invention is a recombinant, purified or isolated polynucleotide comprising, or consisting of a mammalian cDNA sequence, or fragments thereof. In one aspect the sequence is derived from a human, mouse or other mammal. In a preferred aspect, the cDNA sequence is selected from the human cDNA sequences of SEQ ID NO: 3, 69, 112–124 or the complement thereto. In a second preferred aspect, the cDNA sequence is the mouse cDNA sequence of SEQ ID NO: 184. Optionally, said polynucleotide consists of, consists essentially of, or comprises a contiguous span of nucleotides of a mammalian genomic sequence, preferably a sequence selected the following SEQ ID NOs: 3, 69, 112–124 and 184, wherein said contiguous span is at least 6, 8, 10, 12, 15, 20, 25, 30, 50, 100, 200, or 500 nucleotides in length.

A third embodiment of the present invention is a recombinant, purified or isolated polynucleotide, or the complement thereof, encoding a mammalian PG1 protein, or a fragment thereof. In one aspect the PG1 protein sequence is from a human, mouse or other mammal. In a preferred aspect, the PG1 protein sequence is selected from the human PG1 protein sequences of SEQ ID NO: 4, 5, 70, and 125–136. In a second preferred aspect, the PG1 protein sequence is the mouse PG1 protein sequences of SEQ ID NO: 74. Optionally, said fragment of PG1 polypeptide consists of, consists essentially of, or comprises a contiguous stretch of at least 8, 10, 12, 15, 20, 25, 30, 50, 100 or 200 amino acids from SEQ ID NOs: 4, 5, 70, 74, and 125–136, as well as any other human, mouse or mammalian PG1 polypeptide.

A fourth embodiment of the invention are the polynucleotide primers and probes disclosed herein A fifth embodiment of the present invention is a recombinant, purified or isolated polypeptide comprising or consisting of a mammalian PG1 protein, or a fragment thereof. In one aspect the PG1 protein sequence is from a human, mouse or other mammal. In a preferred aspect, the PG1 protein sequence is selected from the human PG1 protein sequences of SEQ ID NO: 4, 5, 70, and 125–136. In a second preferred aspect, the PG1 protein sequence is the mouse PG1 protein sequences of SEQ ID NO: 74. Optionally, said fragment of PG1 polypeptide consists of, consists essentially of, or comprises a contiguous stretch of at least 8, 10, 12, 15, 20, 25, 30, 50, 100 or 200 amino acids from SEQ ID NOs: 4, 5, 70, 74, and 125–136, as well as any other human, mouse or mammalian PG1 polypeptide.

A sixth embodiment of the present invention is an antibody composition capable of specifically binding to a polypeptide of the invention. Optionally, said antibody is polyclonal or monoclonal. Optionally, said polypeptide is an epitope-containing fragment of at least 8, 10, 12, 15, 20, 25, or 30 amino acids of a human, mouse, or mammalian PG1 protein, preferably a sequence selected from SEQ ID NOs: 4, 5, 70, 74, or 125–136.

A seventh embodiment of the present invention is a vector comprising any polynucleotide of the invention. Optionally, said vector is an expression vector, gene therapy vector, amplification vector, gene targeting vector, or knock-out vector.

An eighth embodiment of the present invention is a host cell comprising any vector of the invention.

A ninth embodiment of the present invention is a mammalian host cell comprising a PG1 gene disrupted by homologous recombination with a knock out vector.

A tenth embodiment of the present invention is a nonhuman host mammal or animal comprising a vector of the invention.

A further embodiment of the present invention is a nonhuman host mammal comprising a PG1 gene disrupted by homologous recombination with a knock out vector.

Another embodiment of the present invention is a method of determining whether an individual is at risk of developing cancer or prostate cancer at a later date or whether the individual suffers from cancer or prostate cancer as a result of a mutation in the PG1 gene comprising obtaining a nucleic acid sample from the individual; and determining whether the nucleotides present at one or more of the PG1-related biallelic markers of the invention are indicative of a risk of developing prostate cancer at a later date or indicative of prostate cancer resulting from a mutation in the PG1 gene. Optionally, said PG1-related biallelic is a PG1-related biallelic marker positioned in SEQ ID NO: 179; a PG1-related biallelic marker selected from the group consisting of 99-1485/251, 99-622/95, 99-619/141, 4-76/222, 4-77/151, 4-71/233, 4-72/127, 4-73/134, 99-610/250, 99-609/225, 4-90/283, 99-602/258, 99-600/492, 99-598/130, 99-217/277, 99-576/421, 4-61/269, 4-66/145, and 4-67/40; or a PG1-related biallelic marker selected from the group consisting of 99-622, 4-77, 4-71, 4-73, 99-598, 99-576, and 4-66.

Another embodiment of the present invention is a method of determining whether an individual is at risk of developing prostate cancer at a later date or whether the individual suffers from prostate cancer as a result of a mutation in the PG1 gene comprising obtaining a nucleic acid sample from the individual and determining whether the nucleotides present at one or more of the polymorphic bases in a PG1-related biallelic marker. Optionally, said PG1-related biallelic is a PG1-related biallelic marker positioned in SEQ ID NO: 179; a PG1-related biallelic marker selected from the group consisting of 99-1485/251, 99-622/95, 99-619/141, 4-76/222, 4-77/151, 4-71/233, 4-72/127, 4-73/134, 99-610/250, 99-609/225, 4-90/283, 99-602/258, 99-600/492, 99-598/130, 99-217/277, 99-576/421, 4-61/269, 4-66/145, and 4-67/40; or a PG1-related biallelic marker selected from the group consisting of 99-622, 4-77, 4-71, 4-73, 99-598, 99-576, and 4-66.

Another embodiment of the present invention is a method of obtaining an allele of the PG1 gene which is associated with a detectable phenotype comprising obtaining a nucleic acid sample from an individual expressing the detectable phenotype, contacting the nucleic acid sample with an agent capable of specifically detecting a nucleic acid encoding the PG1 protein, and isolating the nucleic acid encoding the PG1 protein. In one aspect of this method, the contacting step comprises contacting the nucleic acid sample with at least one nucleic acid probe capable of specifically hybridizing to said nucleic acid encoding the PG1 protein. In another aspect of this embodiment, the contacting step comprises contacting the nucleic acid sample with an antibody capable of specifically binding to the PG1 protein. In another aspect of this embodiment, the step of obtaining a nucleic acid sample from an individual expressing a detectable phenotype comprises obtaining a nucleic acid sample from an individual suffering from prostate cancer.

Another embodiment of the present invention is a method of obtaining an allele of the PG1 gene which is associated with a detectable phenotype comprising obtaining a nucleic acid sample from an individual expressing the detectable phenotype, contacting the nucleic acid sample with an agent capable of specifically detecting a sequence within the 8p23 region of the human genome, identifying a nucleic acid encoding the PG1 protein in the nucleic acid sample, and isolating the nucleic acid encoding the PG1 protein. In one aspect of this embodiment, the nucleic acid sample is obtained from an individual suffering from cancer or prostate cancer.

Another embodiment of the present invention is a method of categorizing the risk of prostate cancer in an individual comprising the step of assaying a sample taken from the individual to determine whether the individual carries an allelic variant of PG1 associated with an increased risk of prostate cancer. In one aspect of this embodiment, the sample is a nucleic acid sample. In another aspect a nucleic acid sample is assayed by determining the frequency of the PG1 transcripts present. In another aspect of this embodiment, the sample is a protein sample. In another aspect of this embodiment, the method further comprises determining whether the PG1 protein in the sample binds an antibody specific for a PG1 isoform associated with prostate cancer.

Another embodiment of the present invention is a method of categorizing the risk of prostate cancer in an individual comprising the step of determining whether the identities of the polymorphic bases of one or more biallelic markers which are in linkage disequilibrium with the PG1 gene are indicative of an increased risk of prostate cancer.

Another embodiment of the present invention comprises a method of identifying molecules which specifically bind to a PG1 protein, preferably the protein of SEQ ID NO:4 or a portion thereof: comprising the steps of introducing a nucleic a nucleic acid encoding the protein of SEQ ID NO:4 or a portion thereof into a cell such that the protein of SEQ ID NO:4 or a portion thereof contacts proteins expressed in the cell and identifying those proteins expressed in the cell which specifically interact with the protein of SEQ ID NO:4 or a portion thereof.

Another embodiment of the present invention is a method of identifying molecules which specifically bind to the protein of SEQ ID NO: 4 or a portion thereof. One step of the method comprises linking a first nucleic acid encoding the protein of SEQ ID NO:4 or a portion thereof to a first indicator nucleic acid encoding a first indicator polypeptide to generate a first chimeric nucleic acid encoding a first fusion protein. The first fusion protein comprises the protein of SEQ ID NO:4 or a portion thereof and the first indicator polypeptide. Another step of the method comprises linking a second nucleic acid nucleic acid encoding a test polypeptide to a second indicator nucleic acid encoding a second indicator polypeptide to generate a second chimeric nucleic acid encoding a second fusion protein. The second fusion protein comprises the test polypeptide and the second indicator polypeptide. Association between the first indicator protein and the second indicator protein produces a detectable result. Another step of the method comprises introducing the first chimeric nucleic acid and the second chimeric nucleic acid into a cell. Another step comprises detecting the detectable result.

A further embodiment of the invention is a purified or isolated mammalian PG1 gene or cDNA sequence.

Further embodiments of the present invention include the nucleic acid and amino acid sequences of mutant or low frequency PG1 alleles derived from prostate cancer patients, tissues or cell lines. The present invention also encompasses methods which utilize detection of these mutant PG1 sequences in an individual or tissue sample to diagnosis prostate cancer, assess the risk of developing prostate cancer or assess the likely severity of a particular prostate tumor.

Another embodiment of the invention encompasses any polynucleotide of the invention attached to a solid support. In addition, the polynucleotides of the invention which are attached to a solid support encompass polynucleotides with any further limitation described in this disclosure, or those following: Optionally, said polynucleotides is specified as attached individually or in groups of at least 2, 5, 8, 10, 12, 15, 20, or 25 distinct polynucleotides of the inventions to a single solid support. Optionally, polynucleotides other than those of the invention may attached to the same solid support as polynucleotides of the invention. Optionally, when multiple polynucleotides are attached to a solid support they are attached at random locations, or in an ordered array. Optionally, said ordered array is addressable.

An additional embodiment of the invention encompasses the use of any polynucleotide for, or any polynucleotide for use in, determining the identity of an allele at a PG1-related biallelic marker. In addition, the polynucleotides of the invention for use in determining the identity of an allele at a PG1-related biallelic marker encompass polynucleotides with any further limitation described in this disclosure, or those following: Optionally, said PG1-related biallelic marker is a PG1-related biallelic marker positioned in SEQ ID NO: 179; a PG1-related biallelic marker selected from the group consisting of 99-1485/251, 99-622/95, 99-619/141, 4-76/222, 4-77/151, 4-71/233, 4-72/127, 4-73/134, 99-610/250, 99-609/225, 4-90/283, 99-602/258, 99-600/492, 99-598/130, 99-217/277, 99-576/421, 4-61/269, 4-66/145, and 4-67/40; or a PG1-related biallelic marker selected from the group consisting of 99-622, 4-77, 4-71, 4-73, 99-598, 99-576, and 4-66. Optionally, said polynucleotide may comprise a sequence disclosed in the present specification. Optionally, said polynucleotide may consist of, or consist essentially of any polynucleotide described in the present specification. Optionally, said determining is performed in a hybridization assay, sequencing assay, microsequencing assay, or allele-specific amplification assay. Optionally, said polynucleotide is attached to a solid support, array, or addressable array. Optionally, said polynucleotide is labeled.

Another embodiment of the invention encompasses the use of any polynucleotide for, or any polynucleotide for use in, amplifying a segment of nucleotides comprising an PG1-related biallelic marker. In addition, the polynucleotides of the invention for use in amplifying a segment of nucleotides comprising a PG1-related biallelic marker encompass polynucleotides with any further limitation described in this disclosure, or those following: Optionally, said PG1-related biallelic marker is a PG1-related biallelic marker positioned in SEQ ID NO: 179; a PG1-related biallelic marker selected from the group consisting of 99-1485/251, 99-622/95, 99-619/141, 4-76/222, 4-77/151, 4-71/233, 4-72/127, 4-73/134, 99-610/250, 99-609/225, 4-90/283, 99-602/258, 99-600/492, 99-598/130, 99-217/277, 99-576/421, 4-61/269, 4-66/145, and 4-67/40; or a PG1-related biallelic marker selected from the group consisting of 99-622, 4-77, 4-71, 4-73, 99-598, 99-576, and 4-66. Optionally, said polynucleotide may comprise a sequence disclosed in the present specification. Optionally, said polynucleotide may consist of, or consist essentially of any polynucleotide described in the present specification. Optionally, said amplifying is performed by a PCR or LCR. Optionally, said polynucleotide is attached to a solid support, array, or addressable array. Optionally, said polynucleotide is labeled.

A further embodiment of the invention encompasses methods of genotyping a biological sample comprising determining the identity of an allele at an PG1-related biallelic marker. In addition, the genotyping methods of the invention encompass methods with any further limitation described in this disclosure, or those following: Optionally, said PG1-related biallelic marker is a PG1-related biallelic marker positioned in SEQ ID NO: 179; a PG1-related biallelic marker selected from the group consisting of 99-1485/251, 99-622/95, 99-619/141, 4-76/222, 4-77/151, 4-71/233, 4-72/127, 4-73/134, 99-610/250, 99-609/225, 4-90/283, 99-602/258, 99-600/492, 99-598/130, 99-217/277, 99-576/421, 4-61/269, 4-66/145, and 4-67/40; or a PG1-related biallelic marker selected from the group consisting of 99-622, 4-77, 4-71, 4-73, 99-598, 99-576, and 4-66. Optionally, said method further comprises determining the identity of a second allele at said biallelic marker, wherein said first allele and second allele are not base paired (by Watson & Crick base pairing) to one another. Optionally, said biological sample is derived from a single individual or subject. Optionally, said method is performed in vitro. Optionally, said biallelic marker is determined for both copies of said biallelic marker present in said individual's genome. Optionally, said biological sample is derived from multiple subjects or individuals. Optionally, said method further comprises amplifying a portion of said sequence comprising the biallelic marker prior to said determining step. Optionally, wherein said amplifying is performed by PCR, LCR, or replication of a recombinant vector comprising an origin of replication and said portion in a host cell. Optionally, wherein said determining is performed by a hybridization assay, sequencing assay, microsequencing assay, or allele-specific amplification assay.

An additional embodiment of the invention comprises methods of estimating the frequency of an allele in a population comprising determining the proportional representation of an allele at a PG1-related biallelic marker in said population. In addition, the methods of estimating the frequency of an allele in a population of the invention encompass methods with any further limitation described in this disclosure, or those following: Optionally, said PG1-related biallelic marker is a PG1-related biallelic marker positioned in SEQ ID NO: 179; a PG1-related biallelic marker selected from the group consisting of 99-1485/251, 99-622/95, 99-619/141, 4-76/222, 4-77/151, 4-71/233, 4-72/127, 4-73/134, 99-610/250, 99-609/225, 4-90/283, 99-602/258, 99-600/492, 99-598/130, 99-217/277, 99-576/421, 4-61/269, 4-66/145, and 4-67/40; or a PG1-related biallelic marker selected from the group consisting of 99-622, 4-77, 4-71, 4-73, 99-598, 99-576, and 4-66. Optionally, determining the proportional representation of an allele at a PG1-related biallelic marker is accomplished by determining the identity of the alleles for both copies of said biallelic marker present in the genome of each individual in said population and calculating the proportional representation of said allele at said PG1-related biallelic marker for the population. Optionally, determining the proportional representation is accomplished by performing a genotyping method of the invention on a pooled biological sample derived from a representative number of individuals, or each individual, in said population, and calculating the proportional amount of said nucleotide compared with the total.

A further embodiment of the invention comprises methods of detecting an association between a genotype and a phenotype, comprising the steps of a) genotyping at least one PG1-related biallelic marker in a trait positive population according to a genotyping method of the invention; b) genotyping said PG1-related biallelic marker in a control population according to a genotyping method of the invention; and c) determining whether a statistically significant association exists between said genotype and said phenotype. In addition, the methods of detecting an association between a genotype and a phenotype of the invention encompass methods with any further limitation described in this disclosure, or those following: Optionally, said PG1-related biallelic marker is a PG1-related biallelic marker positioned in SEQ ID NO: 179; a PG1-related biallelic marker selected from the group consisting of 99-1485/251, 99-622/95, 99-619/141, 4-76/222, 4-77/151, 4-71/233, 4-72/127, 4-73/134, 99-610/250, 99-609/225, 4-90/283, 99-602/258, 99-600/492, 99-598/130, 99-217/277, 99-576/421, 4-61/269, 4-66/145, and 4-67/40; or a PG1-related biallelic marker selected from the group consisting of 99-622, 4-77, 4-71, 4-73, 99-598, 99-576, and 4-66. Optionally, said control population is a trait negative population, or a random population. Optionally, each of said genotyping steps a) and b) is performed on a single pooled biological sample derived from each of said populations. Optionally, each of said genotyping of steps a) and b) is performed separately on biological samples derived from each individual in said population or a subsample thereof. Optionally, said phenotype is a disease, cancer or prostate cancer; a response to an anti-cancer agent or an anti-prostate cancer agent; or a side effect to an anti-cancer or anti-prostate cancer agent. Optionally, said method comprises the additional steps of determining the phenotype in said trait positive and said control populations prior to step c).

An additional embodiment of the present invention encompasses methods of estimating the frequency of a haplotype for a set of biallelic markers in a population, comprising the steps of: a) genotyping at least one PG1-related biallelic marker for both copies of said set of biallelic marker present in the genome of each individual in said population or a subsample thereof, according to a genotyping method of the invention; b) genotyping a second biallelic marker by determining the identity of the allele at said second biallelic marker for both copies of said second biallelic marker present in the genome of each individual in said population or said subsample, according to a genotyping method of the invention; and c) applying a haplotype determination method to the identities of the nucleotides determined in steps a) and b) to obtain an estimate of said frequency. In addition, the methods of estimating the frequency of a haplotype of the invention encompass methods with any further limitation described in this disclosure, or those following: Optionally, said PG1-related biallelic marker is a PG1-related biallelic marker positioned in SEQ ID NO: 179; a PG1-related biallelic marker selected from the group consisting of 99-1485/251, 99-622/95, 99-619/141, 4-76/222, 4-77/151, 4-71/233, 4-72/127, 4-73/134, 99-610/250, 99-609/225, 4-90/283, 99-602/258, 99-600/492, 99-598/130, 99-217/277, 99-576/421, 4-61/269, 4-66/145, and 4-67/40; or a PG1-related biallelic marker selected from the group consisting of 99-622, 4-77, 4-71, 4-73, 99-598, 99-576, and 4-66. Optionally, said second biallelic marker is a PG1-related biallelic marker; a PG1-related biallelic marker positioned in SEQ ID NO: 179; a PG1-related biallelic marker selected from the group consisting of 99-1485/251, 99-622/95, 99-619/141, 4-76/222, 4-77/151, 4-71/233, 4-72/127, 4-73/134, 99-610/250, 99-609/225, 4-90/283, 99-602/258, 99-600/492, 99-598/130, 99-217/277, 99-576/421, 4-61/269, 4-66/145, and 4-67/40; or a PG1-related biallelic marker selected from the group consisting of 99-622, 4-77, 4-71, 4-73, 99-598, 99-576, and 4-66. Optionally, said PG1-related biallelic marker and said second biallelic marker are 4-77/151 and 4-66/145. Optionally, said haplotype determination method is an expectation-maximization algorithm.

An additional embodiment of the present invention encompasses methods of detecting an association between a haplotype and a phenotype, comprising the steps of: a) estimating the frequency of at least one haplotype in a trait positive population, according to a method of the invention for estimating the frequency of a haplotype; b) estimating the frequency of said haplotype in a control population, according to a method of the invention for estimating the frequency of a haplotype; and c) determining whether a statistically significant association exists between said haplotype and said phenotype. In addition, the methods of detecting an association between a haplotype and a phenotype of the invention encompass methods with any further limitation described in this disclosure, or those following: Optionally, said PG1-related biallelic is a PG1-related biallelic marker positioned in SEQ ID NO: 179; a PG1-related biallelic marker selected from the group consisting of 99-1485/251, 99-622/95, 99-619/141, 4-76/222, 4-77/151, 4-71/233, 4-72/127, 4-73/134, 99-610/250, 99-609/225, 4-90/283, 99-602/258, 99-600/492, 99-598/130, 99-217/277, 99-576/421, 4-61/269, 4-66/145, and 4-67/40; or a PG1-related biallelic marker selected from the group consisting of 99-622, 4-77, 4-71, 4-73, 99-598, 99-576, and 4-66. Optionally, said PG1-related biallelic marker and said second biallelic marker are 4-77/151 and 4-66/145. Optionally, said haplotype exhibits a p-value of $<1\times10^{-3}$ in an association with a trait positive population with cancer, preferably prostate cancer. Optionally, said control population is a trait negative population, or a random population. Optionally, said phenotype is a disease, cancer or prostate cancer; a response to an anti-cancer agent or an anti-prostate cancer agent, or a side effects to an anti-cancer or anti-prostate cancer agent. Optionally, said method comprises the additional steps of determining the phenotype in said trait positive and said control populations prior to step c).

Additional embodiments and aspects of the present invention are set forth in the Detailed Description of the Invention and the Examples.

BRIEF DESCRIPTION OF THE DRAWINGS

FIG. 4 is a table demonstrating the results of an haplotype analysis. Among all the theoretical potential different haplotypes based on 2 to 9 markers, 11 haplotypes showing a strong association with prostate cancer were selected, and their haplotype analysis results are shown here.

FIG. 6A is a table listing the biallelic markers used in the haplotype analysis of FIG. 4. FIG. 6B is a table listing additional biallelic markers in linkage disequilibrium with the PG1 gene.

FIG. 7 is a table listing the positions of exons, splice sites, a stop codon, and a poly A site in the PG1 gene.

FIG. 9 is a table listing some of the homologies between the PG1 protein and known proteins.

Vector "PG1/1-5" corresponds to an alternative messenger which is due to an alternative splicing, joining exon 1 to exon 5, and resulting in the absence of exons 2, 3 and 4. For PC3 (upper panel) and PNT2 (lower panels), the nucleus was labelled with Propidium iodide (IP). Note that in PC3 cells, EGFP fluorescence was detected in and around the nucleus (GFP, upper middle panel), as shown when the two picture were overlapped (upper right panel). In PNT2A cells, EGFP fluorescence was detected in the cytoplasm (GFP, lower left panel), as shown when the two pictures were overlapped (lower right panel).

FIG. 13 is a half-tome reproduction of a fluorescence micrograph of the perinuclear/nuclear expression of a mutated form PG1 (PG1mut229) in normal prostatic cell line (PNT2). Vector "PG1/1-7" includes exons 1 to 6, and corresponds to the mutated form identified in genomic DNA of the prostatic tumoural cell line LNCaP. The nucleus was labelled with Propidium iodide (IP, left panel). EGFP fluorescence was detected in the cytoplasm (GFP, middle panel), as shown when the two pictures were overlapped (lower right panel).

Figure 14B:
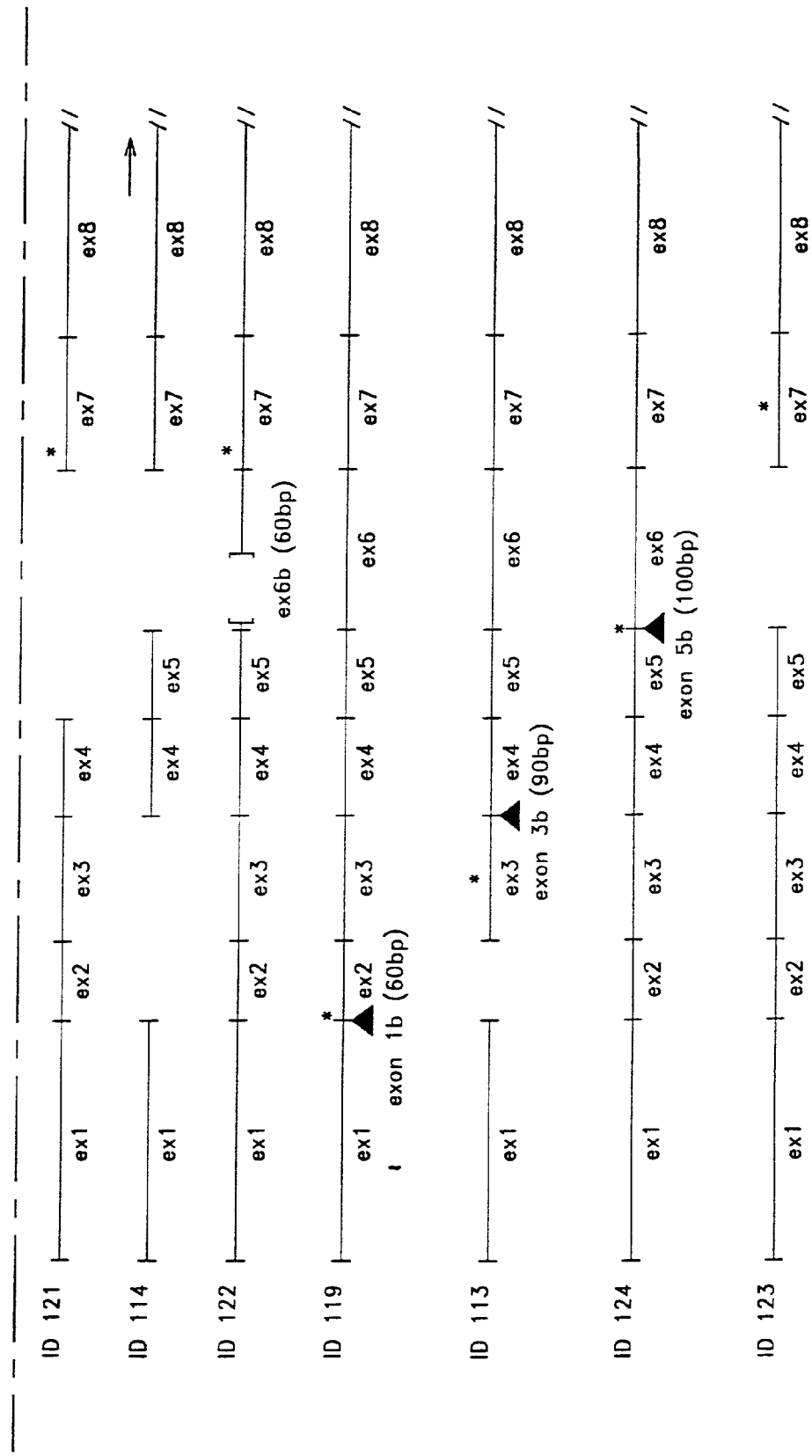

FIG. 14 is a diagram of the structure of the 14 alternative splice species found for human PG1 by the exons present. An * indicates that there is a stop codon in frame at that location. An arrow to the right at the right-hand side of a splice species indicates that the open-reading frame continues off of the chart. a space between exons indicates that the exon(s) is missing from that particular alternative splice species. An up arrow indicates that either exon 1bis, 3bis, or 5bis has been inserted depending upon which is indicated. A bracket notation in exon 6, over an exon 6bis notation indicates that the first 60 bases is missing from exon 6, and exon 6bis is therefor present as a truncated form of exon 6.

Figure 15:
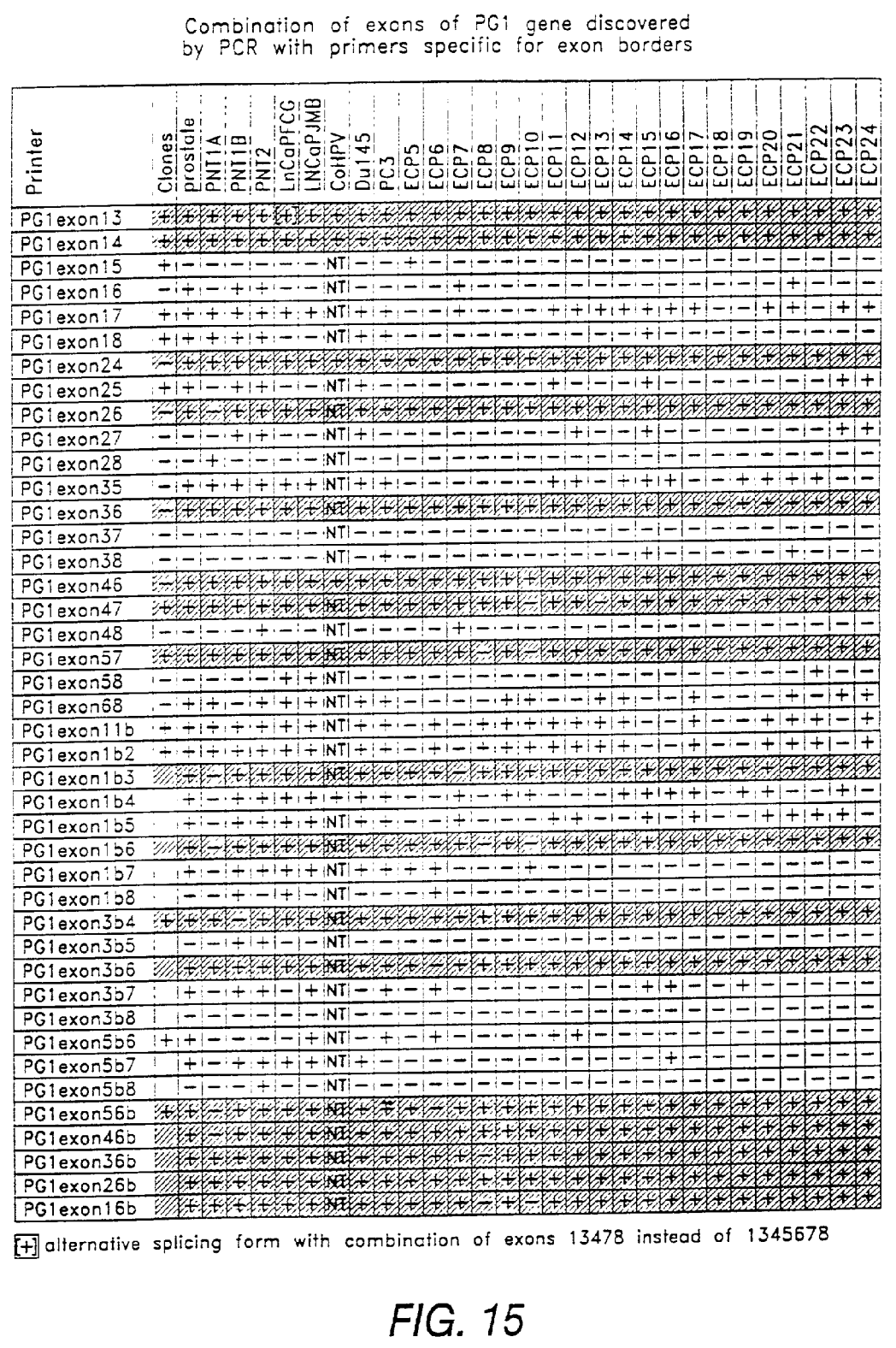

FIG. 15 is a table listing the results of a series of RT-PCR experiments that were performed on RNA of normal prostate, normal prostatic cell lines (PNT1A, PNT1B and PNT2), and tumoral prostatic cell lines (LnCaPFCG, LnCaPJMB, CaHPV, Du145, PC3, and prostate tumors (ECP5 to ECP24) using all the possible combinations of primers (SEQ ID NOs: 137–178) specific to all of the possible splice junctions or exon borders in human PG1. An NT indicates that the experiment was not performed. An [+] indicates the use of an alternative splice species with exons 1, 3, 4, 7, and 8.

Figure 16:
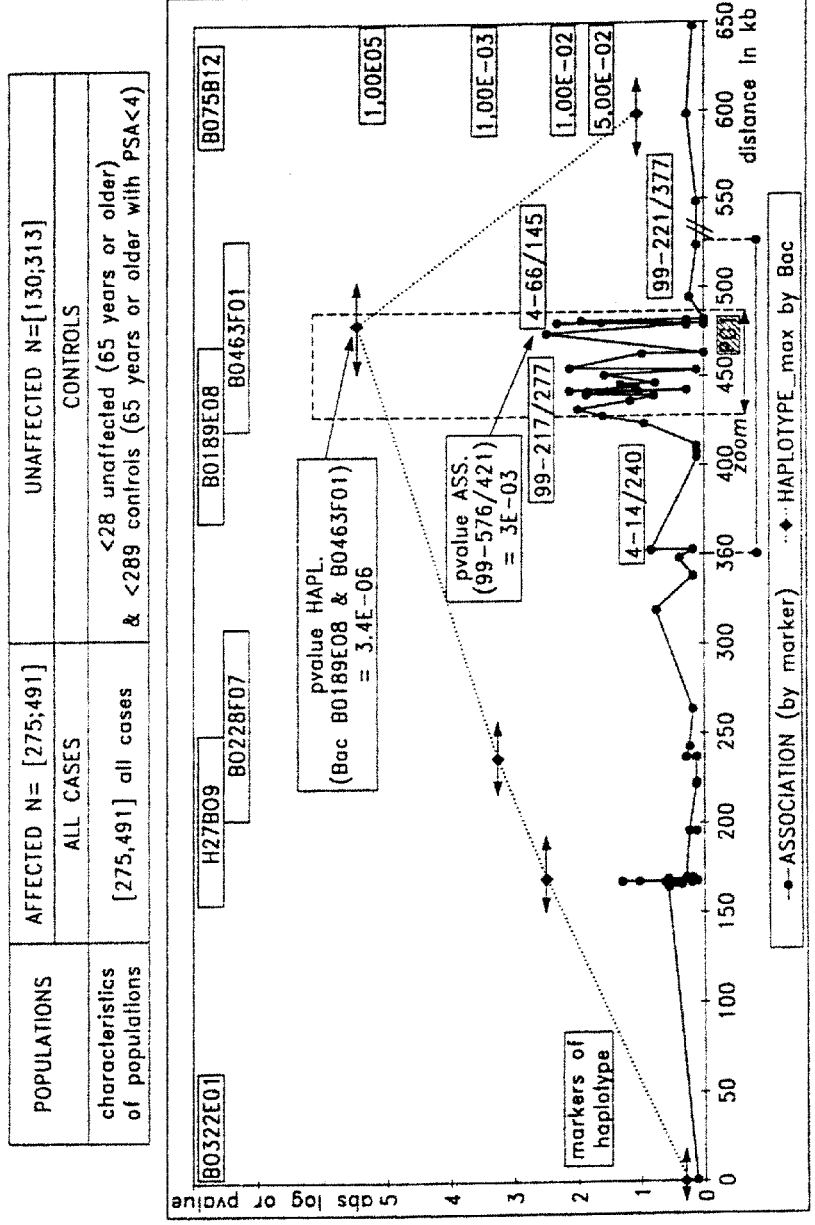

FIG. 16 is a graph showing the results of association studies using markers spanning the 650 kb region of the 8p23 locus around PG1, using both single point analysis and haplotyping studies.

Figure 17:
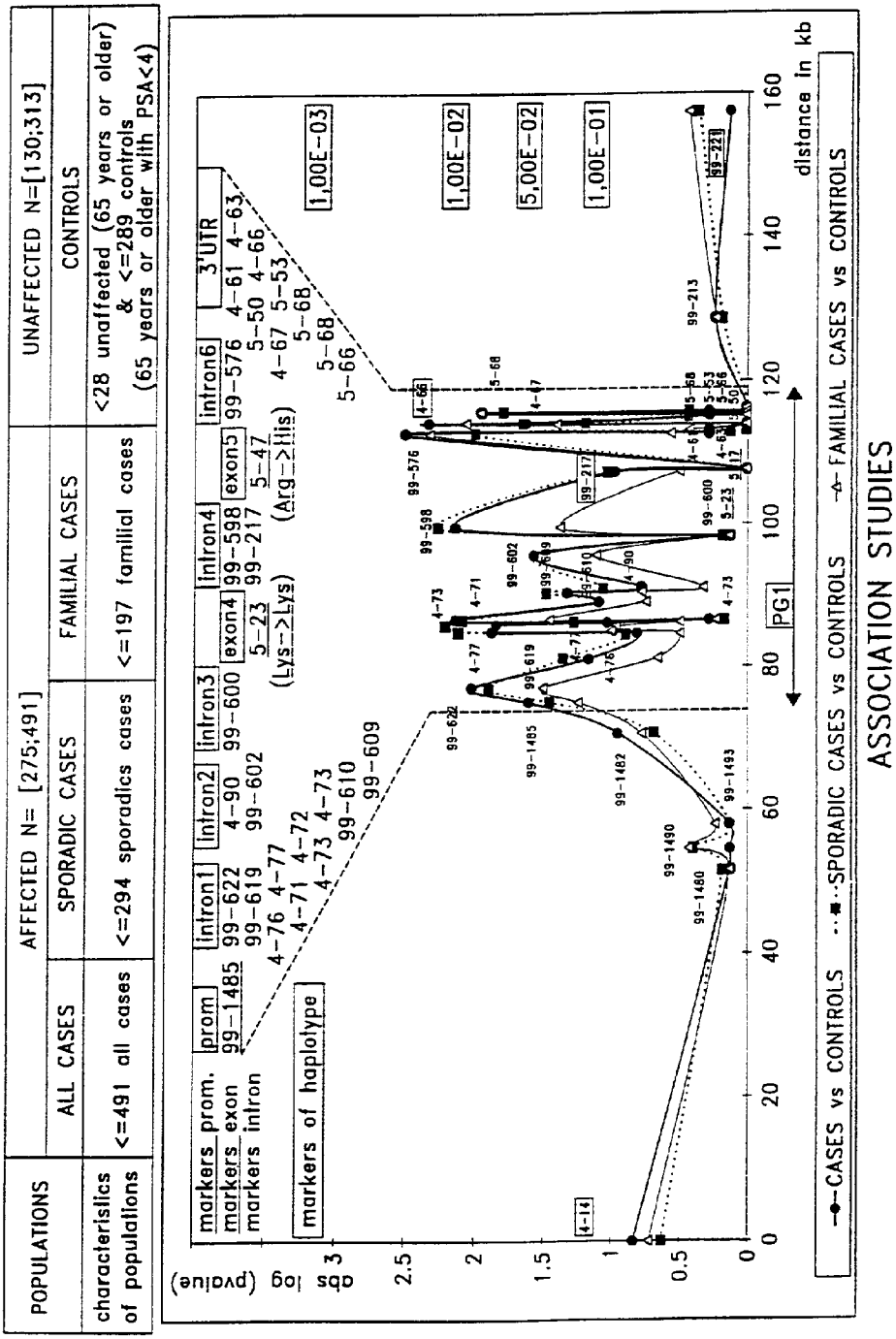

FIG. 17 is a graph showing an enlarged view of the single point association results within a 160 kb region comprising the PG1 gene.

Figure 18A:
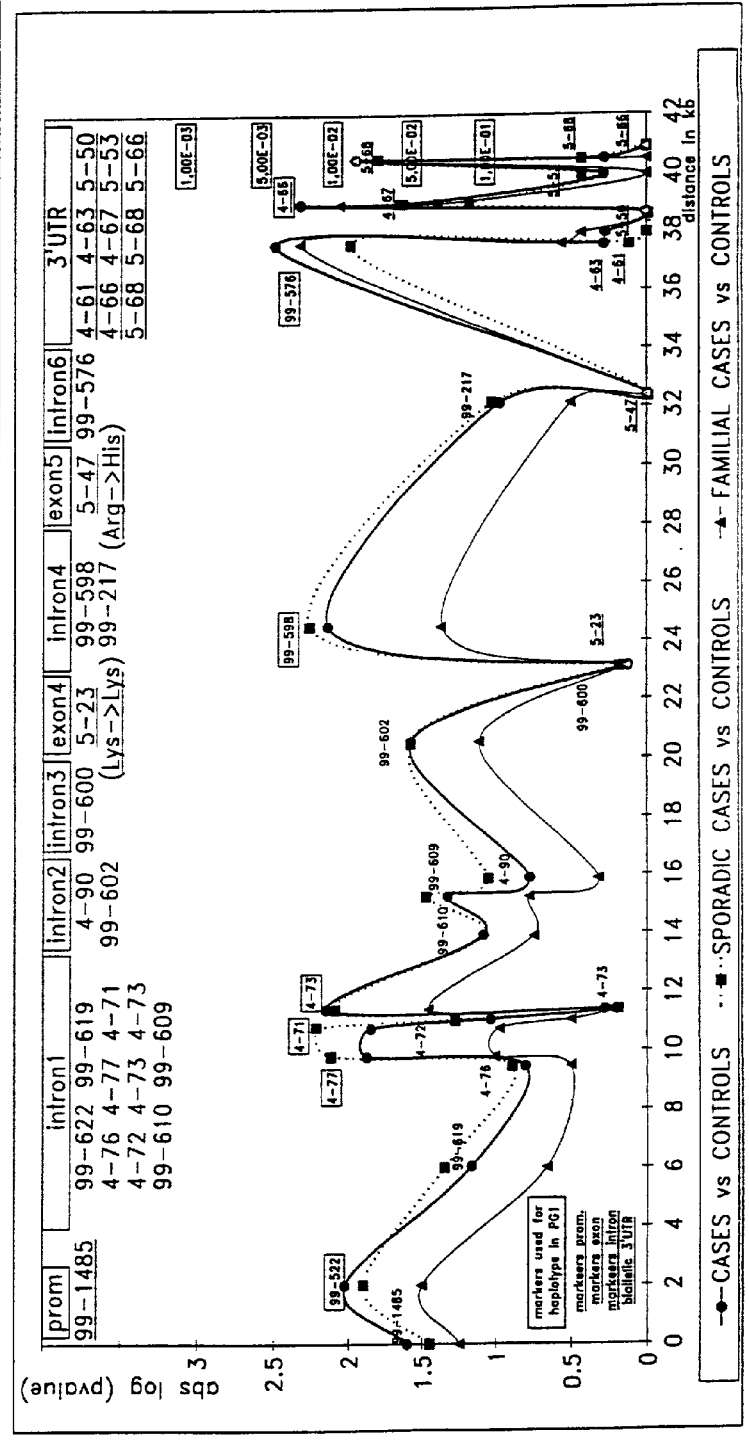

FIG. 18A is a graph showing an enlarged view of the single point association results of 40 kb within the PG1 gene. FIG. 18B is a table listing the location of markers within PG1 gene, the two possible alleles at each site. For each marker, the disease-associated allele is indicated first; its frequencies in cases and controls as well as the difference between both are shown; the odd-ratio and the p-value of each individual marker association are also shown.

FIG. 19A is a table showing the results of a haplotype analysis study using 4 markers (marker Nos. 4-14, 99-217, 4-66 and 99-221)) within the 160 kb region shown in FIG. 17. FIG. 19B is a table showing the segmented haplotyping results according to the subject's age, and whether the prostate cancer cases were sporadic or familial, using the same markers 4 markers and the same individuals as were used to generate the results in FIG. 19A.

FIG. 20 is a table listing the haplotyping results and odd ratios for combinations of the 7 markers (99-622; 4-77; 4-71; 4-73; 99-598; 99-576; 4-66) within PG1 gene that were shown in FIG. 18 to have p-values more significant than $1.10^{-2}$. All of the 2-, 3-, 4-, 5-, 6- and 7-marker haplotypes were tested.

Figure 21:
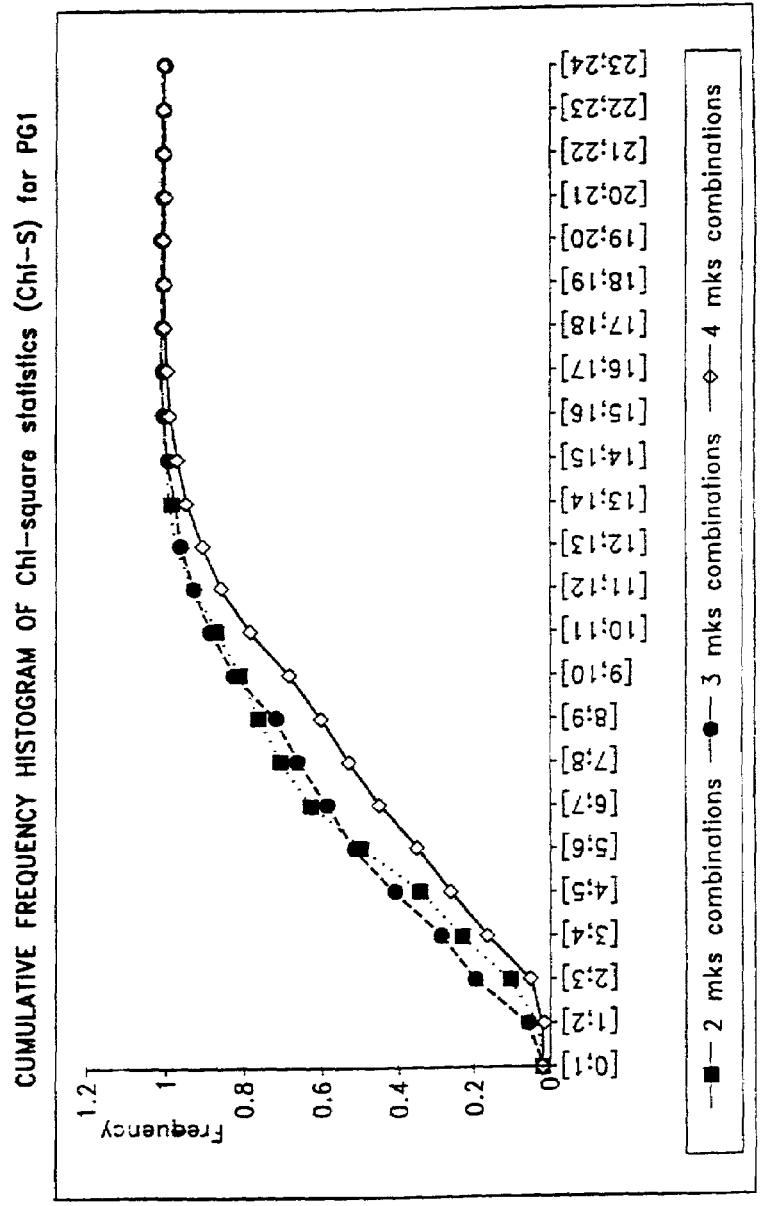

FIG. 21 is a graph showing the distribution of statistical significance, as measured by Chi-square values, for each series of possible x-marker haplotypes, (x=2, 3 or 4) using all of the 19 markers listed in FIG. 18B.

Figure 22:
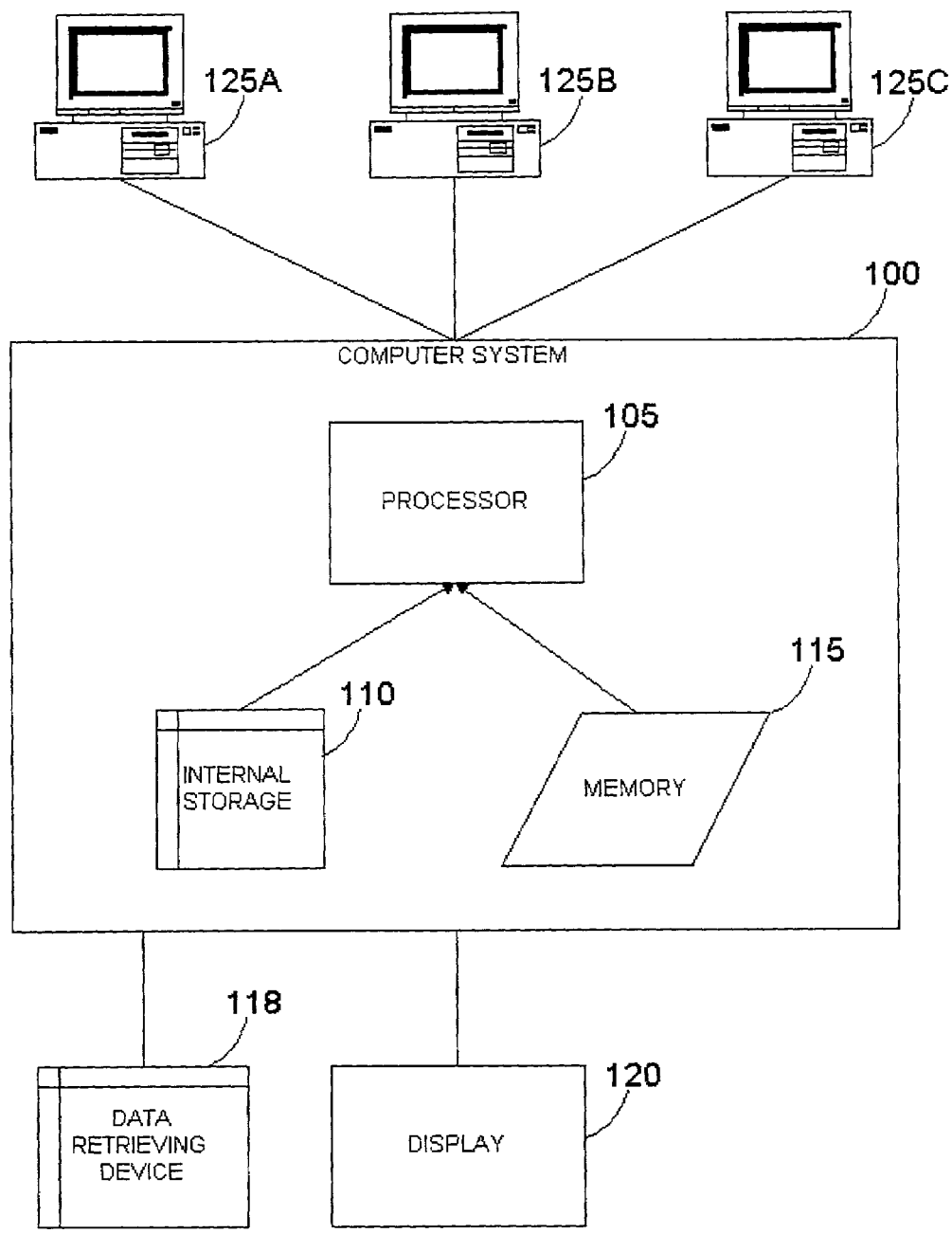

FIG. 22 is a block diagram of an exemplary computer system.

Figure 23:
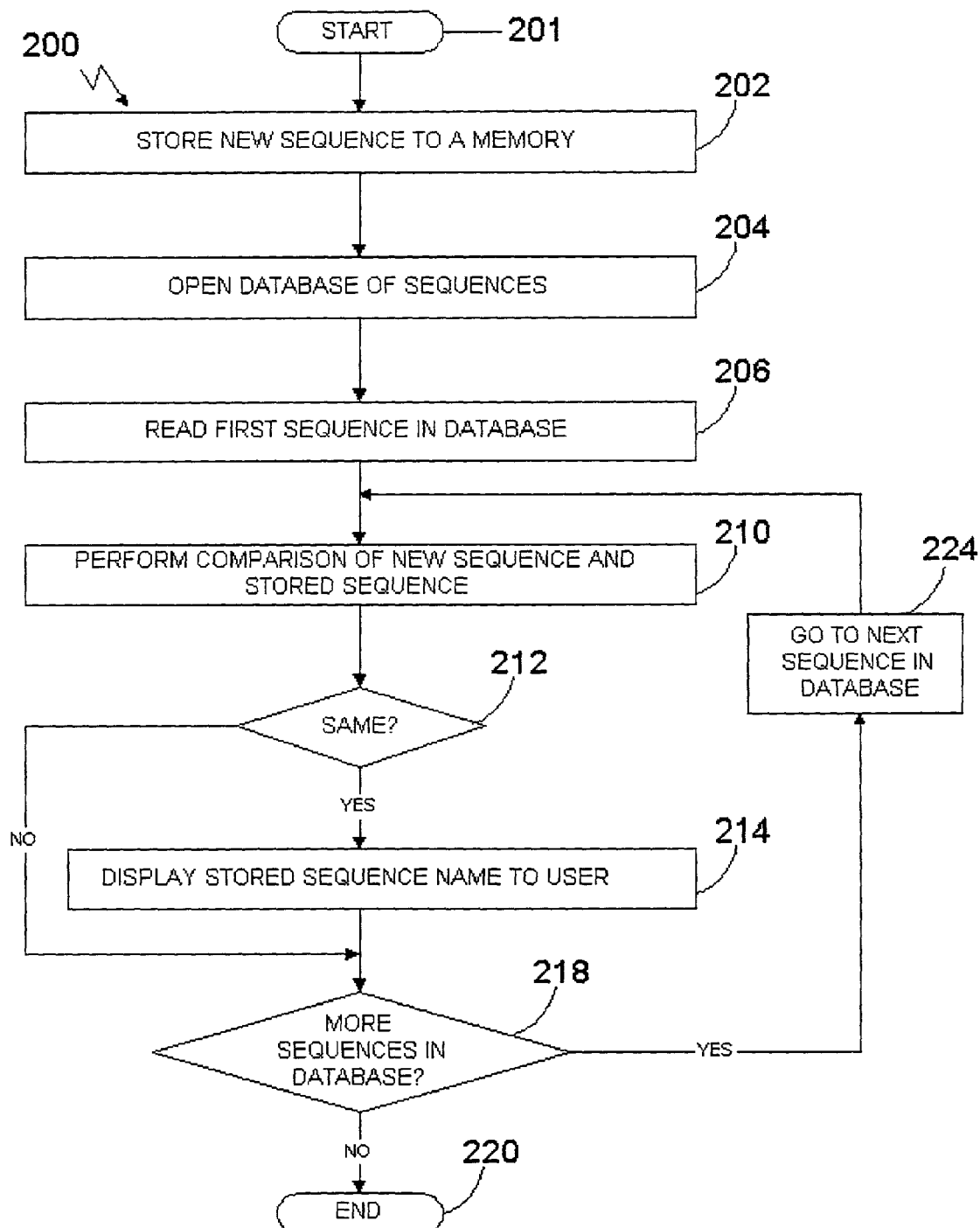

FIG. 23 is a flow diagram illustrating one embodiment of a process 200 for comparing a new nucleotide or protein sequence with a database of sequences in order to determine the homology levels between the new sequence and the sequences in the database.

Figure 24:
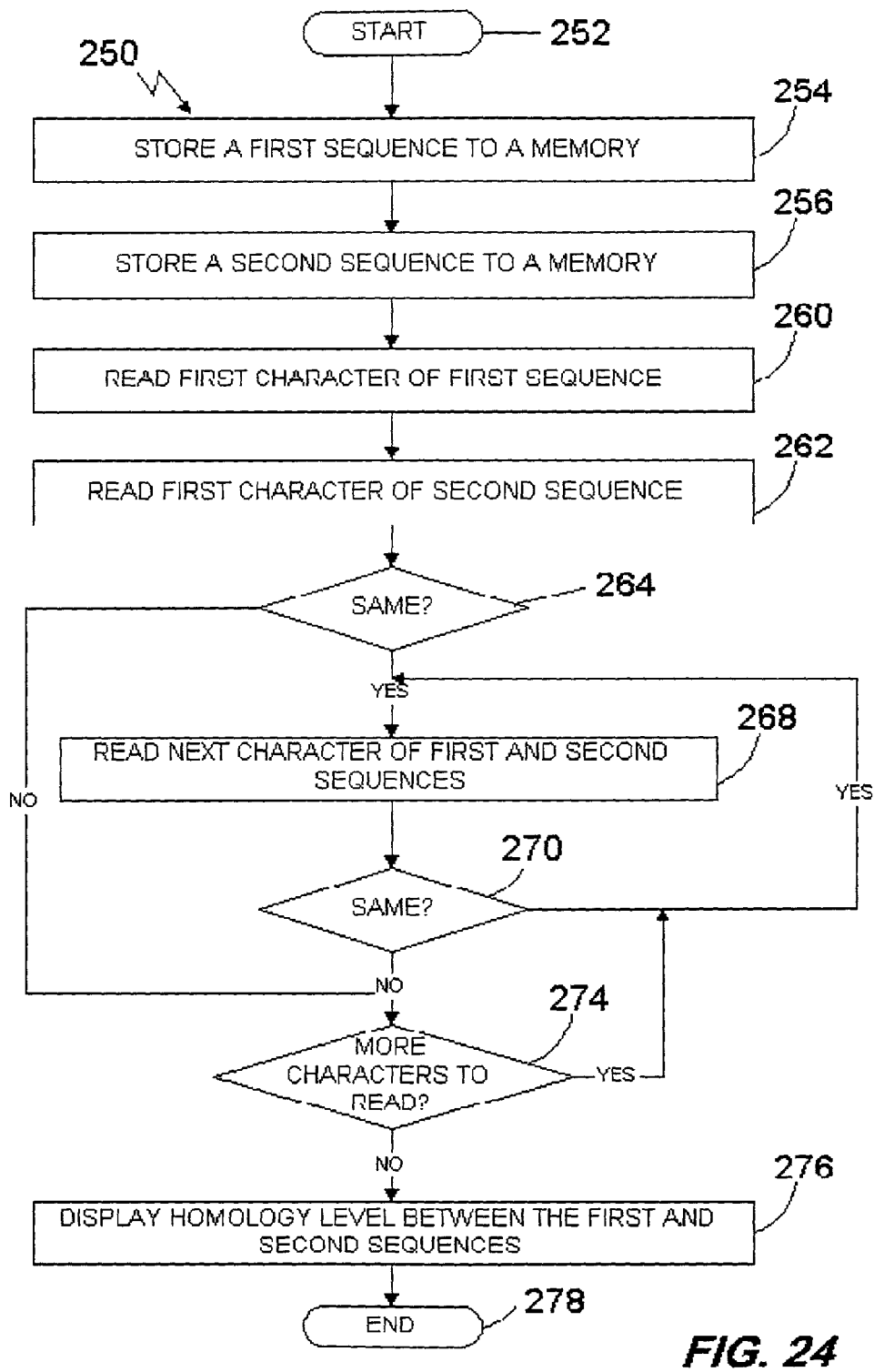

FIG. 24 is a flow diagram illustrating one embodiment of a process 250 in a computer for determining whether two sequences are homologous.

Figure 25:
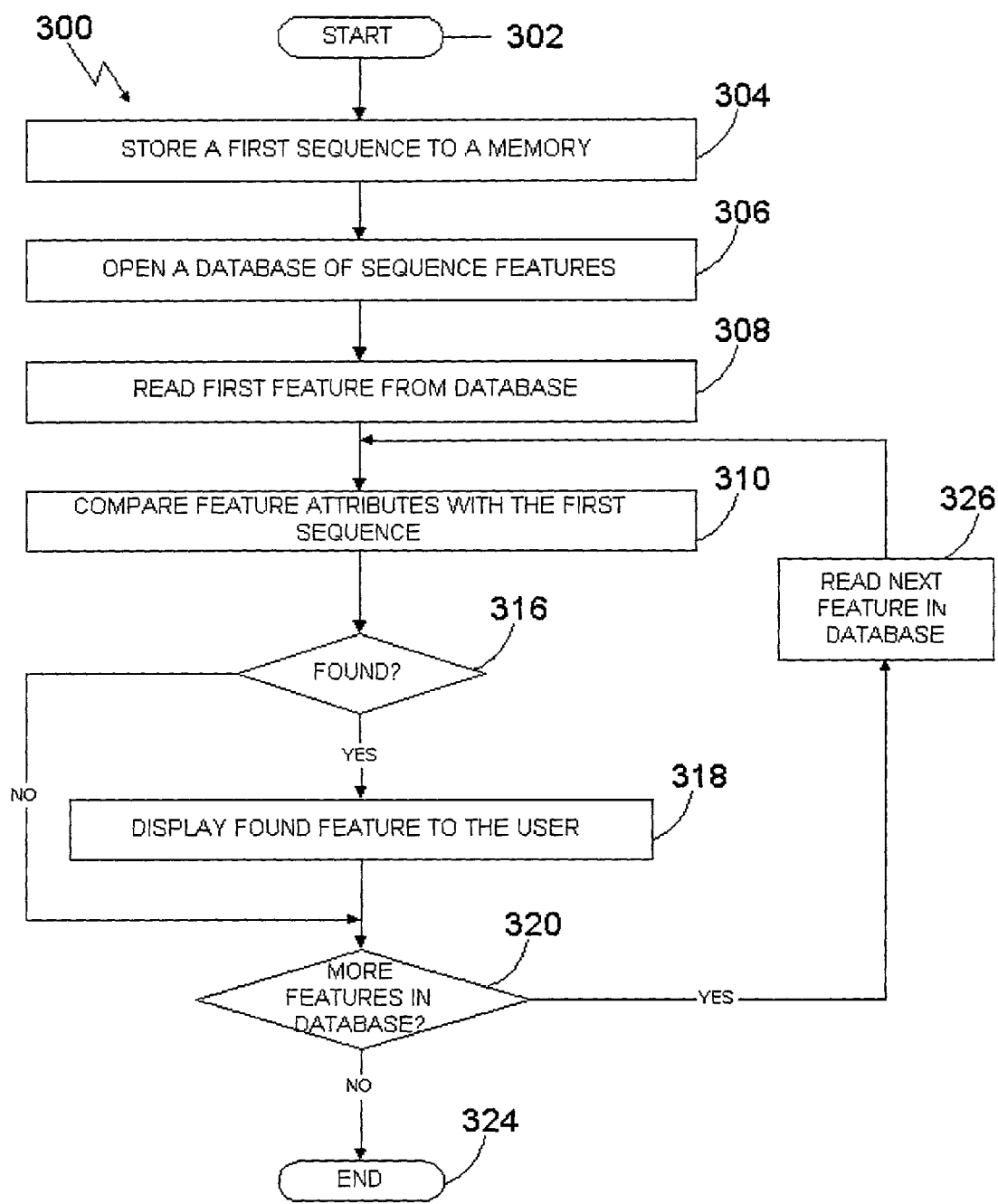

FIG. 25 is a flow diagram illustrating one embodiment of an identifier process 300 for detecting the presence of a feature in a sequence.

DETAILED DESCRIPTION OF THE PREFERRED EMBODIMENT

The practice of the present invention encompasses conventional techniques of chemistry, immunology, molecular biology, biochemistry, protein chemistry, and recombinant DNA technology, which are within the skill of the art. Such techniques are explained fully in the literature. See, eg., *Oligonucleotide Synthesis* (M. Gait ed. 1984); *Nucleic Acid Hybridization* (B. Hames & S. Higgins, eds., 1984); Sambrook, Fritsch & Maniatis, *Molecular Cloning: A Laboratory Manual,* Second Edition (1989); *PCR Technology* (H. A. Erlich ed., Stockton Press); R. Scope, *Protein Purification Principles and Practice* (Springer-Verlag); and the series *Methods in Enzymology* (S. Colowick and N. Kaplan eds., Academic Press, Inc.).

Definitions:

As used interchangeably herein, the terms "nucleic acid" "oligonucleotide", and "polynucleotides" include RNA, DNA, or RNA/DNA hybrid sequences of more than one nucleotide in either single chain or duplex form. The term "nucleotide" as used herein as an adjective to describe molecules comprising RNA, DNA, or RNA/DNA hybrid sequences of any length in single-stranded or duplex form. The term "nucleotide" is also used herein as a noun to refer to individual nucleotides or varieties of nucleotides, meaning a molecule, or individual unit in a larger nucleic acid molecule, comprising a purine or pyrimidine, a ribose or deoxyribose sugar moiety, and a phosphate group, or phosphodiester linkage in the case of nucleotides within an oligonucleotide or polynucleotide. Although the term "nucleotide" is also used herein to encompass "modified nucleotides" which comprise at least one modifications (a) an alternative linking group, (b) an analogous form of purine, (c) an analogous form of pyrimidine, or (d) an analogous sugar, for examples of analogous linking groups, purine, pyrimidines, and sugars see for example PCT publication No. WO 95/04064. However, the polynucleotides of the invention are preferably comprised of greater than 50% conventional deoxyribose nucleotides, and most preferably greater than 90% conventional deoxyribose nucleotides. The polynucleotide sequences of the invention is prepared by any known method, including synthetic, recombinant, ex vivo generation, or a combination thereof, as well as utilizing any purification methods known in the art.

As used herein, the term "purified" does not require absolute purity; rather, it is intended as a relative definition. Purification of starting material or natural material to at least one order of magnitude, preferably two or three orders, and more preferably four or five orders of magnitude is expressly contemplated.

The term "purified" is used herein to describe a polynucleotide or polynucleotide vector of the invention which has been separated from other compounds including, but not limited to other nucleic acids, charbohydrates, lipids and proteins (such as the enzymes used in the synthesis of the polynucleotide), or the separation of covalently closed polynucleotides from linear polynucleotides. A polynucleotide is substantially pure when at least about 50%, preferably 60 to 75% of a sample exhibits a single polynucleotide sequence and conformation (linear versus covalently close). A substantially pure polynucleotide typically comprises about 50%, preferably 60 to 90% weight/weight of a nucleic acid sample, more usually about 95%, and preferably is over about 99% pure. Polynucleotide purity or homogeneity is indicated by a number of means well known in the art, such as agarose or polyacrylamide gel electrophoresis of a sample, followed by visualizing a single polynucleotide band upon staining the gel. For certain purposes higher resolution can be provided by using HPLC or other means well known in the art.

The term "polypeptide" refers to a polymer of amino without regard to the length of the polymer; thus, peptides, oligopeptides, and proteins are included within the definition of polypeptide. This term also does not specify or exclude prost-expression modifications of polypeptides, for example, polypeptides which include the covalent attachment of glycosyl groups, acetyl groups, phosphate groups, lipid groups and the like are expressly encompassed by the term polypeptide. Also included within the definition are polypeptides which contain one or more analogs of an amino acid (including, for example, non-naturally occurring amino acids, amino acids which only occur naturally in an unrelated biological system, modified amino acids from mammalian systems etc.), polypeptides with substituted linkages, as well as other modifications known in the art, both naturally occurring and non-naturally occurring.

As used herein, the term "isolated" requires that the material be removed from its original environment (e.g., the natural environment if it is naturally occurring).

The term "purified" is used herein to describe a polypeptide of the invention which has been separated from other compounds including, but not limited to nucleic acids, lipids, charbohydates and other proteins. A polypeptide is substantially pure when at least about 50%, preferably 60 to 75% of a sample exhibits a single polypeptide sequence. A substantially pure polypeptide typically comprises about 50%, preferably 60 to 90% weight/weight of a protein sample, more usually about 95%, and preferably is over about 99% pure. Polypeptide purity or homogeneity is indicated by a number of means well known in the art, such as agarose or polyacrylamide gel electrophoresis of a sample, followed by visualizing a single polypeptide band upon staining the gel. For certain purposes higher resolution can be provided by using HPLC or other means well known in the art.

As used herein, the term "non-human animal" refers to any non-human vertebrate, birds and more usually mammals, preferably primates, farm animals such as swine, goats, sheep, donkeys, and horses, rabbits or rodents, more preferably rats or mice. As used herein, the term "animal" is used to refer to any vertebrate, preferable a mammal. Both the terms "animal" and "mammal" expressly embrace human subjects unless preceded with the term "non-human".

As used herein, the term "antibody" refers to a polypeptide or group of polypeptides which are comprised of at least one binding domain, where an antibody binding domain is formed from the folding of variable domains of an antibody molecule to form three-dimensional binding spaces with an internal surface shape and charge distribution complementary to the features of an antigenic determinant of an antigen., which allows an immunological reaction with the antigen. Antibodies include recombinant proteins comprising the binding domains, as wells as fragments, including Fab, Fab', F(ab)$_2$, and F(ab')$_2$ fragments.

As used herein, an "antigenic determinant" is the portion of an antigen molecule, in this case an PG1 polypeptide, that determines the specificity of the antigen-antibody reaction. An "epitope" refers to an antigenic determinant of a polypeptide. An epitope can comprise as few as 3 amino acids in a spatial conformation which is unique to the epitope. Generally an epitope consists of at least 6 such amino acids, and more usually at least 8–10 such amino acids. Methods for determining the amino acids which make up an epitope include x-ray crystallography, 2-dimensional nuclear magnetic resonance, and epitope mapping e.g. the Pepscan method described by H. Mario Geysen et al. 1984. Proc. Natl. Acad. Sci. U.S.A. 81:3998–4002; PCT Publication No. WO 84/03564; and PCT Publication No. WO 84/03506.

The term "DNA construct" and "vector" are used herein to mean a purified or isolated polynucleotide that has been artificially designed and which comprises at least two nucleotide sequences that are not found as contiguous nucleotide sequences in their natural environment.

The terms "trait" and "phenotype" are used interchangeably herein and refer to any visible, detectable or otherwise measurable property of an organism such as symptoms of, or susceptibility to a disease for example. Typically the terms "trait" or "phenotype" are used herein to refer to symptoms of, or susceptibility to cancer or prostate cancer; or to refer to an individual's response to an anti-cancer agent or an anti-prostate cancer agent; or to refer to symptoms of, or susceptibility to side effects to an anticancer agent or an anti-prostate cancer agent.

The term "allele" is used herein to refer to variants of a nucleotide sequence. A biallelic polymorphism has two forms. Typically the first identified allele is designated as the original allele whereas other alleles are designated as alternative alleles. Diploid organisms is homozygous or heterozygous for an allelic form.

The term "heterozygosity rate" is used herein to refer to the incidence of individuals in a population, which are heterozygous at a particular allele. In a biallelic system the heterozygosity rate is on average equal to $2P_a(1-P_a)$, where $P_a$ is the frequency of the least common allele. In order to be useful in genetic studies a genetic marker should have an adequate level of heterozygosity to allow a reasonable probability that a randomly selected person will be heterozygous.

The term "genotype" as used herein refers the identity of the alleles present in an individual or a sample. In the context of the present invention a genotype preferably refers to the description of the biallelic marker alleles present in an individual or a sample. The term "genotyping" a sample or an individual for a biallelic marker consists of determining the specific allele or the specific nucleotide carried by an individual at a biallelic marker.

The term "mutation" as used herein refers to a difference in DNA sequence between or among different genomes or individuals which has a frequency below 1%.

The term "haplotype" refers to a combination of alleles present in an individual or a sample. In the context of the present invention a haplotype preferably refers to a combination of biallelic marker alleles found in a given individual and which is associated with a phenotype.

The term "polymorphism" as used herein refers to the occurrence of two or more alternative genomic sequences or alleles between or among different genomes or individuals. "Polymorphic" refers to the condition in which two or more variants of a specific genomic sequence can be found in a population. A "polymorphic site" is the locus at which the variation occurs. A single nucleotide polymorphism is a single base pair change. Typically a single nucleotide polymorphism is the replacement of one nucleotide by another nucleotide at the polymorphic site. Deletion of a single nucleotide or insertion of a single nucleotide, also give rise to single nucleotide polymorphisms. In the context of the present invention "single nucleotide polymorphism" preferably refers to a single nucleotide substitution. Typically, between different genomes or between different individuals, the polymorphic site is occupied by two different nucleotides.

The terms "biallelic polymorphism" and "biallelic marker" are used interchangeably herein to refer to a nucleotide polymorphism having two alleles at a fairly high frequency in the population. A "biallelic marker allele" refers to the nucleotide variants present at a biallelic marker site. Usually a biallelic marker is a single nucleotide polymorphism. However, less commonly there are also insertions and deletions of up to 5 nucleotides which constitute biallelic markers for the purposes of the present invention. Typically the frequency of the less common allele of the biallelic markers of the present invention has been validated to be greater than 1%, preferably the frequency is greater than 10%, more preferably the frequency is at least 20% (i.e. heterozygosity rate of at least 0.32), even more preferably the frequency is at least 30% (i.e. heterozygosity rate of at least 0.42). A biallelic marker wherein the frequency of the less common allele is 30% or more is termed a "high quality biallelic marker."

The location of nucleotides in a polynucleotide with respect to the center of the polynucleotide are described herein in the following manner. When a polynucleotide has an odd number of nucleotides, the nucleotide at an equal distance from the 3' and 5' ends of the polynucleotide is considered to be "at the center" of the polynucleotide, and any nucleotide immediately adjacent to the nucleotide at the center, or the nucleotide at the center itself is considered to be "within 1 nucleotide of the center." With an odd number of nucleotides in a polynucleotide any of the five nucleotides positions in the middle of the polynucleotide would be considered to be within 2 nucleotides of the center, and so on. When a polynucleotide has an even number of nucleotides, there would be a bond and not a nucleotide at the center of the polynucleotide. Thus, either of the two central nucleotides would be considered to be "within 1 nucleotide of the center" and any of the four nucleotides in the middle of the polynucleotide would be considered to be "within 2 nucleotides of the center", and so on.

The term "upstream" is used herein to refer to a location which is toward the 5' end of the polynucleotide from a specific reference point.

The terms "base paired" and "Watson & Crick base paired" are used interchangeably herein to refer to nucleotides which can be hydrogen bonded to one another be virtue of their sequence identities in a manner like that found in double-helical DNA with thymine or uracil residues linked to adenine residues by two hydrogen bonds and cytosine and guanine residues linked by three hydrogen bonds (See Stryer, L., $Biochemistry$, $4^{th}$ edition, 1995).

The terms "complementary" or "complement thereof" are used herein to refer to the sequences of polynucleotides which is capable of forming Watson & Crick base pairing with another specified polynucleotide throughout the entirety of the complementary region. This term is applied to pairs of polynucleotides based solely upon their sequences and not any particular set of conditions under which the two polynucleotides would actually bind.

As used herein the term "PG1-related biallelic marker" relates to a set of biallelic markers in linkage disequilibrium with PG1. The term PG1-related biallelic marker includes all of the biallelic markers used in the initial association studies shown below in Section I.D., including those biallelic markers contained in SEQ ID NOs: 21–38 and 57–62. The term PG1-related biallelic marker encompasses all of the following polymorphisms positioned in SEQ ID 179, and listed by internal reference number, including: 5-63-169 G or C in position 2159; 5-63-453 C or T in position 2443; 99-622-95 T or C in position 4452; 99-621-215 T or C in position 5733; 99-619-141 G or A in position 8438; 4-76-222 deletion of GT in position 11843; 4-76-361 C or T in position 11983; 4-77-151 G or C in position 12080; 4-77-294 A or Gin position 12221; 4-71-33 G or T in position 12947;4-71-233 A or G in position 13147; 4-71-280 G or A in position 13194; 4-71-396 G or C in position 13310; 4-72-127 A or G in position 13342; 4-72-152 A or G in position 13367; 4-72-380 deletion of A in position 13594; 4-73-134 G or C in position 13680; 4-73-356 G or C in position 13902; 99-610-250 T or C in position 16231; 99-610-93 A or T in position 16388; 99-609-225 A or T in position 17608; 4-90-27 A or C in position 18034; 4-90-283 A or C in position 18290; 99-607-397 T or C in position 18786; 99-602-295 deletion of A in position 22835; 99-602-258 T or C in position 22872; 99-600-492 deletion of TATTG in position 25183; 99-600-483 T or G in position 25192; 5-23-288 A or G in position 25614; 99-598-130 T or C in position 26911; 99-592-139 A or T in position 32703; 99-217-277 C or T in position 34491; 5-47-284 A or G in position 34756; 99-589-267 T or G in position 34934; 99-589-41 G or C in position 35160; 99-12899-307 C or T in position 39897; 4-12-68 A or G in position 40598; 99-582-263 T or C in position 40816; 99-582-132 T or C in position 40947; 99-576-421 G or C in position 45783; 4-13-51 C or T in position 47929; 4-13-328 A or T in position 48206; 4-13-329 G or C in position 48207; 99-12903-381 C or T in position 49282; 5-56-208 A or G in position 50037; 5-56-225 A or G in position 50054; 5-56-272 A or G in position 50101; 5-56-391 G or T in position 50220; 4-61-269 A or G in position 50440; 4-61-391 A or G in position 50562; 4-63-99 A or G in position 50653; 4-62-120 A or G in position 50660; 4-62-205 A or G in position 50745; 4-64-113 A or T in position 50885; 4-65-104 A or G in position 51249; 5-28-300 A or G in position 51333; 5-50-269 C or T in position 51435; 4-65-324 C or T in position 51468; 5-71-129 G or C in position 51515; 5-50-391 G or C in position 51557; 5-71-180 A or G in position 51566; 4-67-40 C or T in position 51632; 5-71-280 A or C in position 51666; 5-58-167 A or G in position 52016; 5-30-325 C or T in position 52096; 5-58-302 A or T in position 52151; 5-31-178 A or G in position 52282; 5-31-244 A or G in position 52348; 5-31-306 deletion of A in position 52410; 5-32-190 C or T in position 52524; 5-32-246 C or T in position 52580; 5-32-378 deletion of A in position 52712; 5-53-266 G or C in position 52772; 5-60-158 C or T in position 52860; 5-60-390 A or G in position 53092; 5-68-272 G or C in position 53272; 5-68-385 A or T in position 53389; 5-66-53 deletion of GA in position 53511; 5-66-142 G or C in position 53600; 5-66-207 A or G in position 53665; 5-37-294 A or G in position 53815; 5-62-163 insertion of A in position 54365; 5-62-340 A or T in position 54541; and the compliments thereof. The tern PG1-related biallelic marker also includes all of the following biallelic markers listed by internal reference number, and two SEQ ID NOs each of which contains a 47-mers with one of the two alternative bases at position 24: 4-14-107 of SEQ ID NOs 185 and 262; 4-14-317 of SEQ ID NOs 186 and 263; 4-14-35 of SEQ ID NOs 187 and 264; 4-20-149 of SEQ ID NOs 188 and 265; 4-20-77 of SEQ ID NOs 189 and 266; 4-22-174 of SEQ ID NOs 190 and 267; 4-22-176 of SEQ ID NOs 191 and 268; 4-26-60 of SEQ ID NOs 192 and 269; 4-26-72 of SEQ ID NOs 193 and 270; 4-3-130 of SEQ ID NOs 194 and 271; 4-38-63 of SEQ ID NOs 195 and 272; 4-38-83 of SEQ ID NOs 196 and 273; 4-4-152 of SEQ ID NOs 197 and 274; 4-4-187 of SEQ ID NOs 198 and 275; 4-4-288 of SEQ ID NOs 199 and 276; 4-42-304 of SEQ ID NOs 200 and 277; 4-42401 of SEQ ID NOs 201 and 278; 4-43-328 of SEQ ID NOs 202 and 279; 443-70 of SEQ ID NOs 203 and 280; 4-50-209 of SEQ ID NOs 204 and 281; 4-50-293 of SEQ ID NOs 205 and 282; 4-50-323 of SEQ ID NOs 206 and 283; 4-50-329 of SEQ ID NOs 207 and 284; 4-50-330 of SEQ ID NOs 208 and 285; 4-52-163 of SEQ ID NOs 209 and 286; 4-52-88 of SEQ ID NOs 210 and 287; 4-53-258 of SEQ ID NOs 211 and 288; 4-54-283 of SEQ ID NOs 212 and 289; 4-54-388 of SEQ ID NOs 213 and 290; 4-55-70 of SEQ ID NOs 214 and 291; 4-55-95 of SEQ ID NOs 215 and 292; 4-56-159 of SEQ ID NOs 216 and 293; 4-56-213 of SEQ ID NOs 217 and 294; 4-58-289 of SEQ ID NOs 218 and 295; 4-58-318 of SEQ ID NOs 219 and 296; 4-60-266 of SEQ ID NOs 220 and 297; 4-60-293 of SEQ ID NOs 221 and 298; 4-84-241 of SEQ ID NOs 222 and 299; 4-84-262 of SEQ ID NOs 223 and 300; 4-86-206 of SEQ ID NOs 224 and 301; 4-86-309 of SEQ ID NOs 225 and 302; 4-88-349 of SEQ ID NOs 226 and 303; 4-89-87 of SEQ ID NOs 227 and 304; 99-123-184 of SEQ ID NOs 228 and 305; 99-128-202 of SEQ ID NOs 229 and 306; 99-128-275 of SEQ ID NOs 230 and 307; 99-128-313 of SEQ ID NOs 231 and 308; 99-128-60 of SEQ ID NOs 232 and 309; 99-12907-295 of SEQ ID NOs 233 and 310; 99-130-58 of SEQ ID NOs 234 and 311; 99-134-362 of SEQ ID NOs 235 and 312; 99-140-130 of SEQ ID NOs 236 and 313; 99-1462-238 of SEQ ID NOs 237 and 314; 99-147-181. of SEQ ID NOs 238 and 35; 99-1474-156 of SEQ ID NOs 239 and 316; 99-1474-359 of SEQ ID NOs 240 and 317; 99-1479-158 of SEQ ID NOs 241 and 318; 99-1479-379 of SEQ ID NOs 242 and 319; 99-148-129 of SEQ ID NOs 243 and 320; 99-148-132 of SEQ ID NOs 244 and 321; 99-148-139 of SEQ ID NOs 245 and 322; 99-148-140 of SEQ ID NOs 246 and 323; 99-148-182 of SEQ ID NOs 247 and 324; 99-148-366 of SEQ ID NOs 248 and 325; 99-148-76 of SEQ ID NOs 249 and 326; 99-1480-290 of SEQ ID NOs 250 and 327; 99-1481-285 of SEQ ID NOs 251 and 328; 99-1484-101 of SEQ ID NOs 252 and 329; 99-1484-328 of SEQ ID NOs 253 and 330; 99-1485-251 of SEQ ID NOs 254and 331; 99-1490-381 of SEQ ID NOs 255 and 332; 99-1493-280of SEQ ID NOs 256 and 333; 99-151-94 of SEQ ID NOs 257 and 334; 99-211-291 of SEQ ID NOs 258 and 335; 99-213-37 of SEQ ID NOs 259 and 336; 99-221-442 of SEQ ID NOs 260 and 337; 99-222-109 of SEQ ID NOs 261 and 338; and the compliments thereof.

The term "non-genic" is used herein to describe PG1-related biallelic markers, as well as polynucleotides and primers which do not occur in the human PG1 genomic sequence of SEQ ID NO: 179. The term "genic" is used herein to describe PG1-related biallelic markers as well as polynucleotides and primers which do occur in the human PG1 genomic sequence of SEQ ID NO: 179.

The terms "an anti-cancer agent" refers to a drug or a compound that is capable of reducing the growth rate, rate of metastasis, or viability of tumor cells in a mammal, is capable of reducing the size or eliminating tumors in a mammal, or is capable of increasing the average life span of a mammal or human with cancer. Anti-cancer agents also include compounds which are able to reduce the risk of cancer developing in a population, particularly a high risk population. The terms "an anti-prostate cancer agent" is an anti-cancer agent that has these effects on cells or tumors that are derived from prostate cancer cells.

The terms "response to an anti-cancer agent" and "response to an anti- prostate cancer agent" refer to drug efficacy, including but not limited to ability to metabolize a compound, to the ability to convert a pro-drug to an active drug, and to the pharmacokinetics (absorption, distribution, elimination) and the pharmacodynamics (receptor-related) of a drug in an individual.

The terms "side effects to an anti-cancer agent" and "side effects to an anti-prostate cancer agent" refer to adverse effects of therapy resulting from extensions of the principal pharmacological action of the drug or to idiosyncratic adverse reactions resulting from an interaction of the drug with unique host factors. These side effects include, but are not limited to, adverse reactions such as dermatological, hematological or hepatological toxicities and further includes gastric and intestinal ulceration, disturbance in platelet function, renal injury, nephritis, vasomotor rhinitis with profuse watery secretions, angioneurotic edema, generalized urticaria, and bronchial asthma to laryngeal edema and bronchoconstriction, hypotension, sexual dysfunction, and shock.

As used herein the term "homology" refers to comparisons between protein and/or nucleic acid sequences and is evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, 1988, Proc. Natl. Acad. Sci. USA 85(8):2444–2448; Altschul et al., 1990, J. Mol. Biol. 215 (3):403–410; Thompson et al., 1994, Nucleic Acids Res. 22(2):4673–4680; Higgins et al. 1996, Methods Enzymol. 266:383–402; Altschul et al., 1990, J. Mol. Biol. 215(3): 403–410; Altschul et al., 1993, Nature Genetics 3:266–272). In a particularly preferred embodiment, protein and nucleic acid sequence homologies are evaluated using the Basic Local Alignment Search Tool ("BLAST") which is well known in the art (see, e.g., Karlin and Altschul, 1990, Proc. Natl. Acad. Sci. USA 87:2267–2268; Altschul et al., 1990, J. Mol. Biol. 215:403–410; Altschul et al., 1993, Nature Genetics 3:266–272; Altschul et al., 1997, Nuc. Acids Res. 25:3389–3402). In particular, five specific BLAST programs are used to perform the following task:

(1) BLASTP and BLAST3 compare an amino acid query sequence against a protein sequence database;
(2) BLASTN compares a nucleotide query sequence against a nucleotide sequence database;

(3) BLASTX compares the six-frame conceptual translation products of a query nucleotide sequence (both strands) against a protein sequence database;
(4) TBLASTN compares a query protein sequence against a nucleotide sequence database translated in all six reading frames (both strands); and
(5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., 1992, Science 256:1443–1445; Henikoff and Henikoff, 1993, Proteins 17:49–61). Less preferably, the PAM or PAM250 matrices may also be used (see, e.g., Schwartz and Dayhoff, eds., 1978, Matrices for Detecting Distance Relationships: Atlas of Protein Sequence and Structure, Washington: National Biomedical Research Foundation). The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990, Proc. Natl. Acad. Sci. USA 87:2267–2268).

I. Isolation and Characterization of the PG1 Gene and Proteins

I.A. The 8p23 Region—LOH Studies: Implications of 8p23 Region in Distinct Cancer Types Substantial amounts of LOH data support the hypothesis that genes associated with distinct cancer types are located within 8p23 region of the human genome. Emi, et al., demonstrated the implication of 8p23.1–8p21.3 region in cases of hepatocellular carcinoma, colorectal cancer, and non-small cell lung cancer. (Emi M, Fujiwara Y, Nakajima T, Tsuchiya E, Tsuda H, Hirohashi S, Maeda Y, Tsuruta K, Miyaki M, Nakamura Y, Cancer Res. 1992 Oct. 1; 52(19): 5368–5372) Yaremko, et al., showed the existence of two major regions of LOH for chromosome 8 markers in a sample of 87 colorectal carcinomas. The most prominent loss was found for 8p23.1-pter, where 45% of informative cases demonstrated loss of alleles. (Yaremko M L, Wasylyshyn M L, Paulus K L, Michelassi F, Westbrook C A, Genes Chromosomes Cancer 1994 May;10(1):1–6). Scholnick et al. demonstrated the existence of three distinct regions of LOH for the markers of chromosome 8 in cases of squamous cell carcinoma of the supraglottic larynx. They showed that the allelic loss of 8p23 marker D8S264 serves as a statistically significant, independent predictor of poor prognosis for patients with supraglottic squamous cell carcinoma. (Scholnick S B, Haughey B H, Sunwoo J B, el-Mofty S K, Baty J D, Piccirillo J F, Zequeira M R, J. Natl. Cancer Inst. 1996 Nov. 20; 88(22): 1676–1682 and Sunwoo J B, Holt M S, Radford D M, Deeker C, Scholnick S, Genes Chromosomes Cancer 1996 July; 16(3):164–169).

In other studies, Nagai et al. demonstrated the highest loss of heterozygosity in the specific region of 8p23 by genome wide scanning of LOH in 120 cases of hepatocellular carcinoma (HCC). (Nagai H, Pineau P, Tiollais P, Buendia M A, Dejean A, Oncogene 1997 Jun. 19; 14(24): 2927–2933). Gronwald et al. demonstrated 8p23-pter loss in renal clear cell carcinomas. (Gronwald J, Storkel S, Holtgreve-Grez H, Hadaczek P, Brinkschmidt C, Jauch A, Lubinski J, Cremer, Cancer Res. 1997 Feb. 1; 57(3): 481–487).

The same region is involved in specific cases of prostate cancer. Matsuyama et al. showed the specific deletion of the 8p23 band in prostate cancer cases, as monitored by FISH with D8S7 probe. (Matsuyama H, Pan Y, Skoog L, Tribukait B, Naito K, Ekman P, Lichter P, Bergerheim US Oncogene 1994 October; 9(10): 3071–3076). They were able to document a substantial number of cases with deletions of 8p23 but retention of the 8p22 marker LPL. Moreover, Ichikawa et al. deduced the existence of a prostate cancer metastasis suppressor gene and localized it to 8p23-q12 by studies of metastasis suppression in highly metastatic rat prostate cells after transfer of human chromosomes. (Ichikawa T, Nihei N, Kuramochi H, Kawana Y, Killary A M, Rinker-Schaeffer C W, Barrett J C, Isaacs J T, Kugoh H, Oshimura M, Shimazaki J, Prostate Suppl. 1996; 6: 31–35).

Recently Washburn et al. were able to find substantial numbers of tumors with the allelic loss specific to 8p23 by LOH studies of 31 cases of human prostate cancer. (Washburn J, Woino K, and Macoska J, Proceedings of American Association for Cancer Research, March 1997; 38). In these samples they were able to define the minimal overlapping region with deletions covering genetic interval D8S262–D8S277.

Linkage Analysis Studies: Search for Prostate Cancer

Linked Regions on Chromosome 8

Microsatellite markers mapping to chromosome 8 were used by the inventors to perform linkage analysis studies on 194 individuals issued from 47 families affected with prostate cancer. While multiple point analysis led to weak linkage results, two point lod score analysis led to non significant results, as shown below.

Two Point Lod (Parametric Analysis)

| MARKER | Distance (cM) | Z(lod) scores |
|---|---|---|
| D8S1742 | 0.8 | −0.13 |
| D8S561 | | −0.07 |

| | |
|---|---|
| # of families analyzed | 47 |
| Total # of individuals genotyped | 194 |
| Total # of affected individuals genotyped | 122 |

In view of the non-significant results obtained with linkage analysis, a new mapping approach based on linkage disequilibrium of biallelic markers was utilised to identify genes responsible for sporadic cases of prostate cancer.

I.B. Linkage Disequilibrium Using Biallelic Markers to Identify Candidate Loci Responsible for Disease

Linkage Disequilibrium

Once a chromosomal region has been identified as potentially harboring a candidate gene associated with a sporadic trait, an excellent approach to refine the candidate gene's location within the identified region is to look for statistical associations between the trait and some marker genotype when comparing an affected (trait⁺) and a control (trait⁻) population.

Association studies have most usually relied on the use of biallelic markers. Biallelic markers are genome-derived polynucleotides that exhibit biallelic polymorphism at one single base position. By definition, the lowest allele frequency of a biallelic polymorphism is 1%; sequence variants that show allele frequencies below 1% are called rare mutations. There are potentially more than $10^7$ biallelic markers lying along the human genome.

Association studies seek to establish correlations between traits and genetic markers and are based on the phenomenon of linkage disequilibrium (LD). LD is defined as the trend for alleles at nearby loci on haploid genomes to correlate in the population. If two genetic loci lie on the same chromosome, then sets of alleles on the same chromosomal segment (i.e., haplotypes) tend to be transmitted as a block from generation to generation. When not broken up by recombination, haplotypes can be tracked not only through pedigrees but also through populations. The resulting phenomenon at the population level is that the occurrence of pairs of specific alleles at different loci on the same chromosome is not random, and the deviation from random is called linkage disequilibrium.

Since results generated by association studies are essentially based on the quantitative calculation of allele frequencies, they best apply to the analysis of germline mutations. This is mainly due to the fact that allelic frequencies are difficult to quantify within tumor tissue samples because of the usual presence of normal cells within the studied tumor samples. Association studies applied to cancer genetics will therefore be best suited to the identification of tumor suppressor genes.

Trait Localization by Linkage Disequilibrium Mapping

Any gene responsible or partly responsible for a given trait will be in LD with some flanking markers. To map such a gene, specific alleles of these flanking markers which are associated with the gene or genes responsible for the trait are identified. Although the following discussion of techniques for finding the gene or genes associated with a particular trait using linkage disequilibrium mapping, refers to locating a single gene which is responsible for the trait, it will be appreciated that the same techniques may also be used to identify genes which are partially responsible for the trait.

Association studies is conducted within the general population (as opposed to the linkage analysis techniques discussed above which are limited to studies performed on related individuals in one or several affected families).

Association between a biallelic marker A and a trait T may primarily occur as a result of three possible relationships between the biallelic marker and the trait. First, allele α of biallelic marker A is directly responsible for trait T (e.g., Apo E e4 allele and Alzheimer's disease). However, since the majority of the biallelic markers used in genetic mapping studies are selected randomly, they mainly map outside of genes. Thus, the likelihood of allele α being a functional mutation directly related to trait T is therefore very low.

An association between a biallelic marker A and a trait T may also occur when the biallelic marker is very closely linked to the trait locus. In other words, an association occurs when allele α is in linkage disequilibrium with the trait-causing allele. When the biallelic marker is in close proximity to a gene responsible for the trait, more extensive genetic mapping will ultimately allow a gene to be discovered near the marker locus which carries mutations in people with trait T (i.e. the gene responsible for the trait or one of the genes responsible for the trait). As will be further exemplified below using a group of biallelic markers which are in close proximity to the gene responsible for the trait, the location of the causal gene can be deduced from the profile of the association curve between the biallelic markers and the trait. The causal gene will be found in the vicinity of the marker showing the highest association with the trait.

Finally, an association between a biallelic marker and a trait may occur when people with the trait and people without the trait correspond to genetically different subsets of the population who, coincidentally, also differ in the frequency of allele α (population stratification). This phenomenon is avoided by using large heterogeneous samples.

Association studies are particularly suited to the efficient identification of susceptibility genes that present common polymorphisms, and are involved in multifactorial traits whose frequency is relatively higher than that of diseases with monofactorial inheritance.

Application of Linkage Disequilibrium Mapping to Candidate Gene Identification The general strategy of association studies using a set of biallelic markers, is to scan two pools of individuals (affected individuals and unaffected controls) characterized by a well defined phenotype in order to measure the allele frequencies for a number of the chosen markers in each of these pools. If a positive association with a trait is identified using an array of biallelic markers having a high enough density, the causal gene will be physically located in the vicinity of the associated markers, since the markers showing positive association to the trait are in linkage disequilibrium with the trait locus. Regions harboring a gene responsible for a particular trait which are identified through association studies using high density sets of biallelic markers will, on average, be 20–40 times shorter in length than those identified by linkage analysis.

Once a positive association is confirmed as described above, BACs (bacterial artificial chromosomes) obtained from human genomic libraries, constructed as described below, harboring the markers identified in the association analysis are completely sequenced.

Once a candidate region has been sequenced and analyzed, the functional sequences within the candidate region (exons and promoters, and other potential regulatory regions) are scanned for mutations which are responsible for the trait by comparing the sequences of a selected number of controls and affected individuals using appropriate software. Candidate mutations are further confirmed by screening a larger number of affected individuals and controls using the microsequencing techniques described below.

Candidate mutations are identified as follows. A pair of oligonucleotide primers is designed in order to amplify the sequences of every predicted functional region. PCR amplification of each predicted functional sequence is carried out on genomic DNA samples from affected patients and unaffected controls. Amplification products from genomic PCR are subjected to automated dideoxy terminator sequencing reactions and electrophoresed on ABI 377 sequencers. Following gel image analysis and DNA sequence extraction, the sequence data are automatically analyzed to detect the presence of sequence variations among affected cases and unaffected controls. Sequences are systematically verified by comparing the sequences of both DNA strands of each individual.

Polymorphisms are then verified by screening a larger population of affected individuals and controls using the microsequencing technique described below in an individual test format. Polymorphisms are considered as candidate mutations when present in affected individuals and controls at frequencies compatible with the expected association results.

Association Studies: Statistical Analysis and Haplotyping

As mentioned above, linkage analysis typically localizes a disease gene to a chromosomal region of several megabases. Further refinement in location requires the analysis of additional families in order to increase the number of recombinants. However, this approach becomes unfeasible because recombination is rarely observed even within large pedigrees (Boehnke, M, 1994, Am. J. Hum. Genet. 55: 379–390).

Linkage disequilibrium, the nonrandom association of alleles at linked loci, may offer an alternative method of obtaining additional recombinants. When a chromosome carrying a mutant allele of a gene responsible for a given trait is first introduced into a population as a result of either mutation or migration, the mutant allele necessarily resides on a chromosome having a unique set of linked markers (haplotype). Consequently, there is complete disequilibrium between these markers and the disease mutation: the disease mutation is present only linked to a specific set of marker alleles. Through subsequent generations, recombinations occur between the disease mutation and these marker polymorphisms, resulting in a gradual disappearance of disequilibrium. The degree of disequilibrium dissipation depends on the recombination frequency, so the markers closest to the disease gene will tend to show higher levels of disequilibrium than those that are farther away (Jorde L B, 1995, Am. J. Hum. Genet. 56: 11–14). Because linkage disequilibrium patterns in a present-day population reflect the action of recombination through many past generations, disequilibrium analysis effectively increases the sample of recombinants. Thus the mapping resolution achieved through the analysis of linkage disequilibrium patterns is much higher than that of linkage analysis.

In practice, in order to define the regions bearing a candidate gene, the affected and control populations are genotyped using an appropriate number of biallelic markers (at a density of 1 marker every 50–150 kilobases). Then, a marker/trait association study is performed that compares the genotype frequency of each biallelic marker in the affected and control populations by means of a chi square statistical test (one degree of freedom).

After the first screening, additional markers within the region showing positive association are genotyped in the affected and control populations. Two types of complementary analysis are then performed. First, a marker/trait association study (as described above) is performed to refine the location of the gene responsible for the trait. In addition, a haplotype association analysis is performed to define the frequency and the type of the ancestral/preferential carrier haplotype. Haplotype analysis, by combining the informativeness of a set of biallelic markers increases the power of the association analysis, allowing false positive and/or negative data that may result from the single marker studies to be eliminated.

The haplotype analysis is performed by estimating the frequencies of all possible haplotypes for a given set of biallelic markers in the case and control populations, and comparing these frequencies by means of a chi square statistical test (one degree of freedom). Haplotype estimations are performed by applying the Expectation-Maximization (EM) algorithm (Excoffier L & Slatkin M, 1995, Mol. Biol. Evol. 12: 921–927), using the EM-HAPLO program (Hawley M E, Pakstis A J & Kidd K K, 1994, Am. J. Phys. Anthropol. 18: 104). The EM algorithm is used to estimate haplotype frequencies in the case when only genotype data from unrelated individuals are available. The EM algorithm is a generalized iterative maximum likelihood approach to estimation that is useful when data are ambiguous and/or incomplete.

The application of biallelic marker based linkage disequilibrium analysis to the 8p23 region to identify a gene associated with prostate cancer is described below.

I.C. Application of Linkage Disequilibrium Mapping to the 8p23 Region YAC Contig Construction in 8p23 Region First, a YAC contig which contains the 8p23 region was constructed as follows. The CEPH-Genethon YAC map for the entire human genome (Chumakov I. M. et al. A YAC contig map of the human genome, Nature, 377 Supp.: 175–297, 1995) was used for detailed contig building in the region around D8S262 and D8S277 genetic markers. Screening data available for regional genetic markers D8S1706, D8S277, D8S1742, D8S518, D8S262, D8S1798, D8S1140, D8S561 and D8S1819 were used to select the following set of CEPH YACs, localized within this region: 832_g_12, 787_c_11, 920_h_7, 807_a_1, 842_b_1, 745_a_3, 910_d_3, 879_f_11, 918_c_6, 764_c_7, 910_f_12, 967_c_11, 856_d_8, 792_a_6, 812_h_4, 873_c_8, 930_a_2, 807_a_1, 852_d_10. This set of YACs was tested by PCR with the above mentioned genetic markers as well as with other publicly available markers supposedly located within the 8p23 region. As a result of these studies, a YAC STS contig map was generated around genetic markers D8S262 and D8S277. The two CEPH YACs, 920_h_7 (1170 kb insert size) and 910_f_12 (1480 kb insert size) constitute a minimal tiling path in this region, with an estimated size of ca. 2 Megabases.

During this mapping effort, the following publicly known STS markers were precisely located within the contig: WI-14718, WI-3831, D8S1413E, WI-8327, WI-3823, ND4.

BAC Contig Construction Covering
D8S262–D8S277

Fragment Within 8p23 Region of the Human
Genome

Following construction of the YAC contig, a BAC contig was constructed as follows. BAC libraries were obtained as described in Woo et al. Nucleic Acids Res., 1994, 22, 4922–4931. Briefly, two different whole human genome libraries were produced by cloning BamHI or HindIII partially digested DNA from a lymphoblastoid cell line (derived from individual N°8445, CEPH families) into the pBelo-BAC11 vector (Kim et al. Genomics, 1996, 34, 213–218). The library produced with the BamHI partial digestion contained 110,000 clones with an average insert size of 150 kb, which corresponds to 5 human haploid genome equivalents. The library prepared with the HindIII partial digestion corresponds to 3 human genome equivalents with an average insert size of 150 kb.

BAC Screening

The human genomic BAC libraries obtained as described above were screened with all of the above mentioned STSs. DNA from the clones in both libraries was isolated and pooled in a three dimensional format ready for PCR screening with the above mentioned STSs using high throughput PCR methods (Chumakov et al., Nature 1995, 377: 175–298). Briefly, three dimensional pooling consists in rearranging the samples to be tested in a manner which allows the number of PCR reactions required to screen the clones with STSs to be reduced by at least 100 fold, as compared to screening each clone individually. PCR amplification products were detected by conventional agarose gel electrophoresis combined with automated image capturing and processing.

In a final step, STS-positive clones were checked individually. Subchromosomal localization of BACs was systematically verified by fluorescence in situ hybridization (FISH), performed on metaphasic chromosomes as described by Cherif et al. Proc. Natl. Acad. Sci. USA 1990, 87: 6639–6643.

BAC insert size was determined by Pulsed Field Gel Electrophoresis after digestion with restriction enzyme NotI.

BAC Contig Analysis

The ordered BACs selected by STS screening and verified by FISH, were assembled into contigs and new markers were generated by partial sequencing of insert ends from some of them. These markers were used to fill the gaps in the contig of BAC clones covering the chromosomal region around D8S277, having an estimated size of 2 megabases. Selected BAC clones from the contig were subcloned and sequenced.

BAC Subcloning

Each BAC human DNA was first extracted using the alkaline lysis procedure and then sheared by sonication. The obtained DNA fragments were end-repaired and electrophoresed on preparative agarose gels. The fragments in the desired size range were isolated from the gel, purified and ligated to a linearized, dephosphorylated, blunt-ended plasmid cloning vector (pBluescript II Sk (+)). Example 1 describes the BAC subcloning procedure.

EXAMPLE 1

The cells obtained from three liters overnight culture of each BAC clone were treated by alkaline lysis using conventional techniques to obtain the BAC DNA containing the genomic DNA inserts. After centrifugation of the BAC DNA in a cesium chloride gradient, ca. 50 µg of BAC DNA was purified. 5–10 µg of BAC DNA was sonicated using three distinct conditions, to obtain fragments of the desired size. The fragments were treated in a 50 µl volume with two units of Vent polymerase for 20 min at 70° C., in the presence of the four deoxytriphosphates (100 µM). The resulting blunt-ended fragments were separated by electrophoresis on low-melting point 1% agarose gels (60 Volts for 3 hours). The fragments were excised from the gel and treated with agarase. After chloroform extraction and dialysis on Microcon 100 columns, DNA in solution was adjusted to a 100 ng/µl concentration. A ligation was performed overnight by adding 100 ng of BAC fragmented DNA to 20 ng of pBluescript II Sk (+) vector DNA linearized by enzymatic digestion, and treated by alkaline phosphatase. The ligation reaction was performed in a 10 µl final volume in the presence of 40 units/µl T4 DNA ligase (Epicentre). The ligated products were electroporated into the appropriate cells (ElectroMAX *E.coli* DH10B cells). IPTG and X-gal were added to the cell mixture, which was then spread on the surface of an ampicillin-containing agar plate. After overnight incubation at 37° C., recombinant (white) colonies were randomly picked and arrayed in 96 well microplates for storage and sequencing.

Partial Sequencing of BACs

At least 30 of the obtained BAC clones were sequenced by the end pair-wise method (500 bp sequence from each end) using a dye-primer cycle sequencing procedure. Pair-wise sequencing was performed until a map allowing the relative positioning of selected markers along the corresponding DNA region was established. Example 2 describes the sequencing and ordering of the BAC inserts.

EXAMPLE 2

The subclone inserts were amplified by PCR on overnight bacterial cultures, using vector primers flanking the insertions. The insert extremity sequences (on average 500 bases at each end) were determined by fluorescent automated sequencing on ABI 377 sequencers, with a ABI Prism DNA Sequencing Analysis software (2.1.2 version).

The sequence fragments from BAC subclones were assembled using Gap4 software from R. Staden (Bonfield et al. 1995). This software allows the reconstruction of a single sequence from sequence fragments. The sequence deduced from the alignment of different fragments is called the consensus sequence. We used directed sequencing techniques (primer walking) to complete sequences and link contigs.

Figure 1:
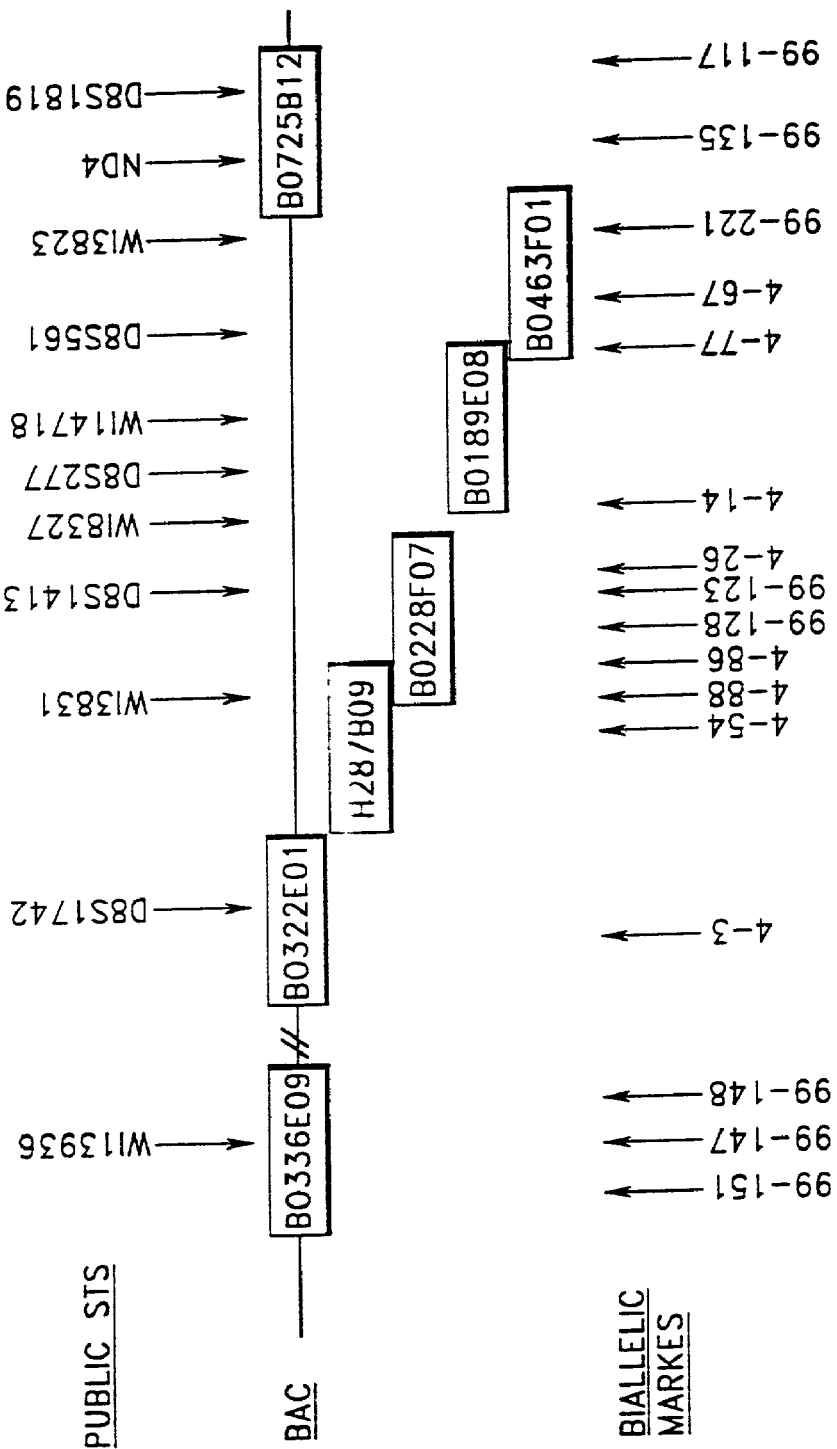
FIG. 1 is a diagram showing the BAC contig containing the PG1 gene and the positions of biallelic markers along the contig.

FIG. 1 shows the overlapping BAC subclones (labeled BAC) which make up the assembled contig and the positions of the publicly known STS markers along the contig.

Identification of Biallelic Markers Lying Along the BAC Contig

Following assembly of the BAC contig, biallelic markers lying along the contig were then identified. Given that the assessed distribution of informative biallelic markers in the human genome (biallelic polymorphisms with a heterozygosity rate higher than 42%) is one in 2.5 to 3 kb, six 500 bp genomic fragments have to be screened in order to identify 1 biallelic marker. Six pairs of primers per potential marker, each one defining a ca. 500 bp amplification fragment, were derived from the above mentioned BAC partial sequences. All primers contained a common upstream oligonucleotide tail enabling the easy systematic sequencing of the resulting amplification fragments. Amplification of each BAC-derived sequence was carried out on pools of DNA from ca. 100 individuals. The conditions used for the polymerase chain reaction were optimized so as to obtain more than 95% of PCR products giving 500 bp-sequence reads.

The amplification products from genomic PCR using the oligonucleotides derived from the BAC subclones were subjected to automated dideoxy terminator sequencing reactions using a dye-primer cycle sequencing protocol. Following gel image analysis and DNA sequence extraction, sequence data were automatically processed with appropriate software to assess sequence quality and to detect the presence of biallelic sites among the pooled amplified fragments. Biallelic sites were systematically verified by comparing the sequences of both strands of each pool.

The detection limit for the frequency of biallelic polymorphisms detected by sequencing pools of 100 individuals is 0.3+/−0.05 for the minor allele, as verified by sequencing pools of known allelic frequencies. Thus, the biallelic markers selected by this method will be "informative biallelic markers" since they have a frequency of 0.3 to 0.5 for the minor allele and 0.5 to 0.7 for the major allele, therefore an average heterozygosity rate higher than 42%.

Example 3 describes the preparation of genomic DNA samples from the individuals screened to identify biallelic markers.

EXAMPLE 3

The population used in order to generate biallelic markers in the region of interest consisted of ca. 100 unrelated individuals corresponding to a French heterogeneous population.

DNA was extracted from peripheral venous blood of each donor as follows.

30 ml of blood were taken in the presence of EDTA. Cells (pellet) were collected after centrifugation for 10 minutes at 2000 rpm. Red cells were lysed by a lysis solution (50 ml final volume: 10 mM Tris pH7.6; 5 MM $MgCl_2$; 10 mM NaCl). The solution was centrifuged (10 minutes, 2000 rpm) as many times as necessary to eliminate the residual red cells present in the supernatant, after resuspension of the pellet in the lysis solution.

The pellet of white cells was lysed overnight at 42° C. with 3.7 ml of lysis solution composed of:

3 ml TE 10-2 (Tris-HCl 10 mM, EDTA 2 mM)/NaCl 0.4 M

200 μl SDS 10%

500 μl K-proteinase (2 mg K-proteinase in TE 10-2/NaCl 0.4 M).

For the extraction of proteins, 1 ml saturated NaCl (6M) (1/3.5 v/v) was added. After vigorous agitation, the solution was centrifuged for 20 minutes at 10000 rpm.

For the precipitation of DNA, 2 to 3 volumes of 100% ethanol were added to the previous supernatant, and the solution was centrifuged for 30 minutes at 2000 rpm. The DNA solution was rinsed three times with 70% ethanol to eliminate salts, and centrifuged for 20 minutes at 2000 rpm. The pellet was dried at 37° C., and resuspended in 1 ml TE 10-1 or 1 ml water. The DNA concentration was evaluated by measuring the OD at 260 nm (1 unit OD=50 μg/ml DNA).

To determine the presence of proteins in the DNA solution, the OD 260/OD 280 ratio was determined. Only DNA preparations having a OD 260/OD 280 ratio between 1.8 and 2 were used in the subsequent steps described below.

DNA Amplification

Once each BAC was isolated, pairs of primers, each one defining a 500 bp-amplification fragment, were designed. Each of the primers contained a common oligonucleotide tail upstream of the specific bases targeted for amplification, allowing the amplification products from each set of primers to be sequenced using the common sequence as a sequencing primer. The primers used for the genomic amplification of sequences derived from BACs were defined with the OSP software (Hillier L. and Green P. Methods Appl., 1991, 1: 124–8). The synthesis of primers was performed following the phosphoramidite method, on a GENSET UFPS 24.1 synthesizer.

Example 4 provides the procedures used in the amplification reactions.

EXAMPLE 4

The amplification of each sequence was performed by PCR (Polymerase Chain Reaction) as follows:

| | |
|---|---|
| final volume | 50 μl |
| genomic DNA | 100 ng |
| $MgCl_2$ | 2 mM |
| dNTP (each) | 200 μM |
| primer (each) | 7.5 pmoles |
| Ampli Taq Gold DNA polymerase (Perkin) | 1 unit |
| PCR buffer (10 X = 0.1 M Tris HCl pH 8.3, 0.5 M KCl) | 1 X. |

The amplification was performed on a Perkin Elmer 9600 Thermocycler or MJ Research PTC200 with heating lid. After heating at 94° C. for 10 minutes, 35 cycles were performed. Each cycle comprised: 30 sec at 94° C., 1 minute at 55° C., and 30 sec at 72° C. final elongation, 7 minutes at 72° C. ended the amplification.

The obtained quantity of amplification products was determined on 96-well microtiter plates, using a fluorimeter and Picogreen as intercalating agent (Molecular Probes).

The sequences of the amplification products were determined for each of the approximately 100 individuals from whom genomic DNA was obtained. Those amplification products which contained biallelic markers were identified.

FIG. 1 shows the locations of the biallelic markers along the 8p23 BAC contig. This first set of markers corresponds to a medium density map of the candidate locus, with an inter-marker distance averaging 50 kb–150 kb.

A second set of biallelic markers was then generated as described above in order to provide a very high-density map of the region identified using the first set of markers which can be used to conduct association studies, as explained below. The high density map has markers spaced on average every 2–50 kb.

The biallelic markers were then used in association studies as described below.

Collection of DNA Samples from Affected and Non-affected Individuals

Prostate cancer patients were recruited according to clinical inclusion criteria based on pathological or radical prostatectomy records. Control cases included in this study were both ethnically- and age-matched to the affected cases; they were checked for both the absence of all clinical and biological criteria defining the presence or the risk of prostate cancer, and for the absence of related familial prostate cancer cases. Both affected and control individuals corresponded to unrelated cases.

The two following pools of independent individuals were used in the association studies. The first pool, comprising individuals suffering from prostate cancer, contained 185 individuals. Of these 185 cases of prostate cancer, 45 cases were sporadic and 140 cases were familial. The second pool, the control pool, contained 104 non-diseased individuals.

Haplotype analysis was conducted using additional diseased (total samples: 281) and control samples (total samples: 130), from individuals recruited according to similar criteria.

Genotyping Affected and Control Individuals

The general strategy to perform the association studies was to individually scan the DNA samples from all individuals in each of the two populations described above in order to establish the allele frequencies of the above described biallelic markers in each of these populations.

Allelic frequencies of the above-described biallelic markers in each population were determined by performing microsequencing reactions on amplified fragments obtained by genomic PCR performed on the DNA samples from each individual.

DNA samples and amplification products from genomic PCR were obtained in similar conditions as those described above for the generation of biallelic markers, and subjected to automated microsequencing reactions using fluorescent ddNTPs (specific fluorescence for each ddNTP) and the appropriate oligonucleotide microsequencing primers which hybridized just upstream of the polymorphic base. Once specifically extended at the 3' end by a DNA polymerase using the complementary fluorescent dideoxynucleotide analog (thermal cycling), the primer was precipitated to remove the unincorporated fluorescent ddNTPs. The reaction products were analyzed by electrophoresis on ABI 377 sequencing machines.

Example 5 describes one microsequencing procedure.

EXAMPLE 5

5 µl of PCR products in a microtiter plate were added to 5 µl purification mix {2 U SAP (Amersham); 2 U Exonuclease I (Amersham); 1 µl SAP10× buffer: 400 mM Tris-HCl pH8, 100 mM MgCl2; H2O final volume 5 µl}. The reaction mixture was incubated 30 minutes at 37° C., and denatured 10 minutes at 94° C. After 10 sec centrifugation, the microsequencing reaction was performed on line with the whole purified reaction mixture (10 µl) in the microplate using 10 pmol microsequencing oligonucleotide (23 mers, GENSET, crude synthesis, 5 OD), 0.5 U Thermosequenase (Amersham), 1.25 µl Thermosequenase 16× buffer (Amersham), both of the fluorescent ddNTPs (Perkin Elmer) corresponding to the polymorphism {0.025 µl ddTTP and ddCTP, 0.05 µl ddATP and ddGTP}, H2O to a final volume of 20 µl. A PCR program on a GeneAmp 9600 thermocycler was carried out as follows: 4 minutes at 94° C.; 5 sec at 55° C./10 sec at 94° C. for 20 cycles. The re mixture was incubated at 4° C. until precipitation. The microtiter plate was centrifuged 10 sec at 1500 rpm. 19 µl MgCl2 2 mM and 55 µl 100% ethanol were added in each well. After 15 minute incubation at room temperature, the microtiter plate was centrifuged at 3300 rpm 15 minutes at 4° C. Supernatants were discarded by inverting the microtitre plate on a box folded to proper size and by centrifugation at 300 rpm 2 minutes at 4° C. afterwards. The microplate was then dried 5 minutes in a vacuum drier. The pellets were resuspended in 2.5 µl formamide EDTA loading buffer (0.7 µl of 9 µg/µl dextran blue in 25 mM EDTA and 1.8 µl formamide). A 10% polyacrylamide gel/12 cm/64 wells was pre-run for 5 minutes on a 377 ABI 377 sequencer. After 5 minutes denaturation at 100° C., 0.8 µl of each microsequencing reaction product was loaded in each well of the gel. After migration (2 h 30 for 2 microtiter plates of PCR products per gel), the fluorescent signals emitted by the incorporated ddNTPs were analyzed on the ABI 377 sequencer using the GENESCAN software (Perkin Elmer). Following gel analysis, data were automatically processed with a software that allowed the determination of the alleles of biallelic markers present in each amplified fragment.

I.D. Initial Association Studies

Figure 2:
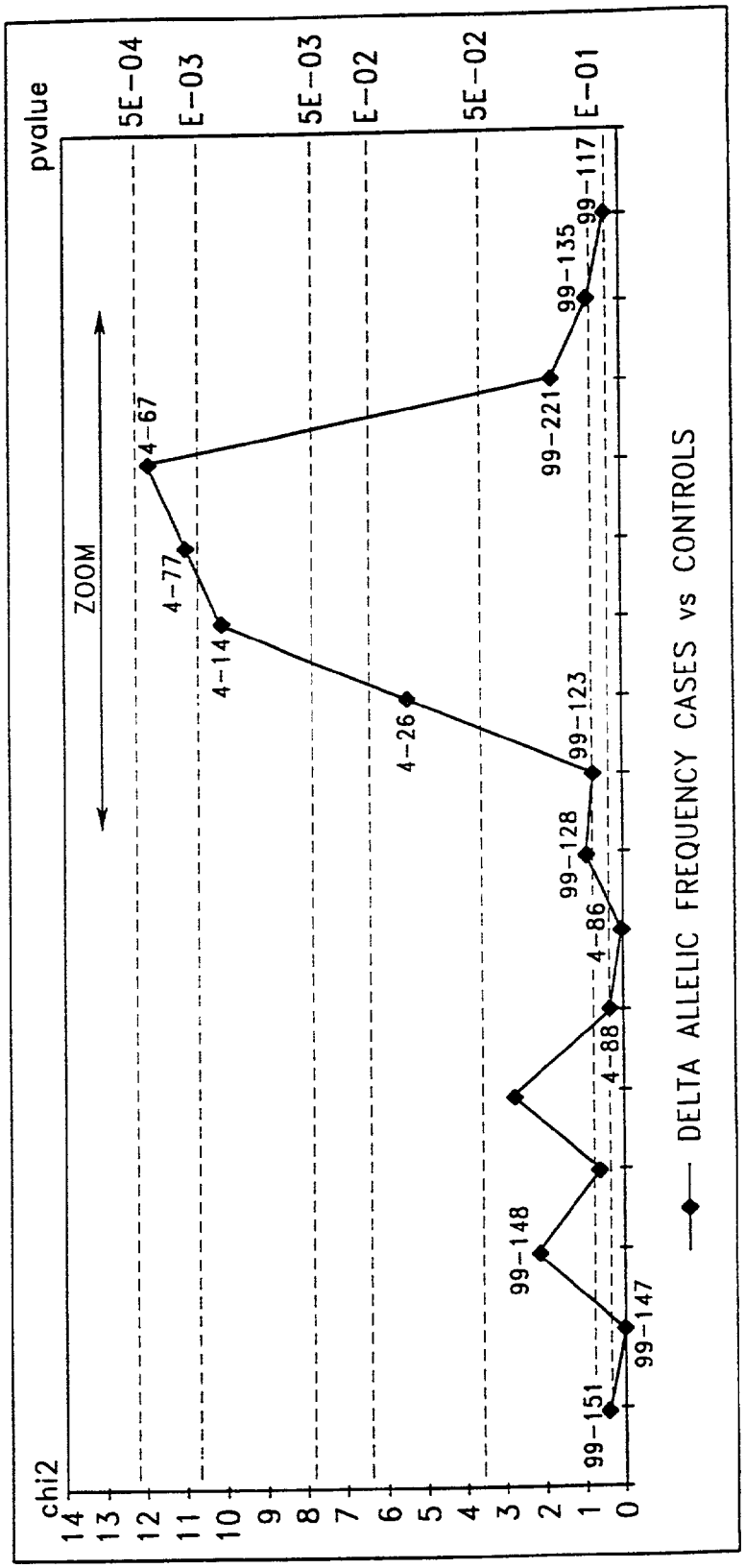
FIG. 2 is a graph showing the results of the first screening of a prostate cancer association study and the significance of various biallelic markers as measured by their chi squared and p-values for a low density set of markers.

Association studies were run in two successive steps. In a first step, a rough localization of the candidate gene was achieved by determining the frequencies of the biallelic markers of FIG. 1 in the affected and unaffected populations. The results of this rough localization are shown in FIG. 2. This analysis indicated that a gene responsible for prostate cancer was located near the biallelic marker designated 4-67.

In a second phase of the analysis, the position of the gene responsible for prostate cancer was further refined using the very high density set of markers described above. The results of this localization are shown in FIG. 3.

Figure 3:
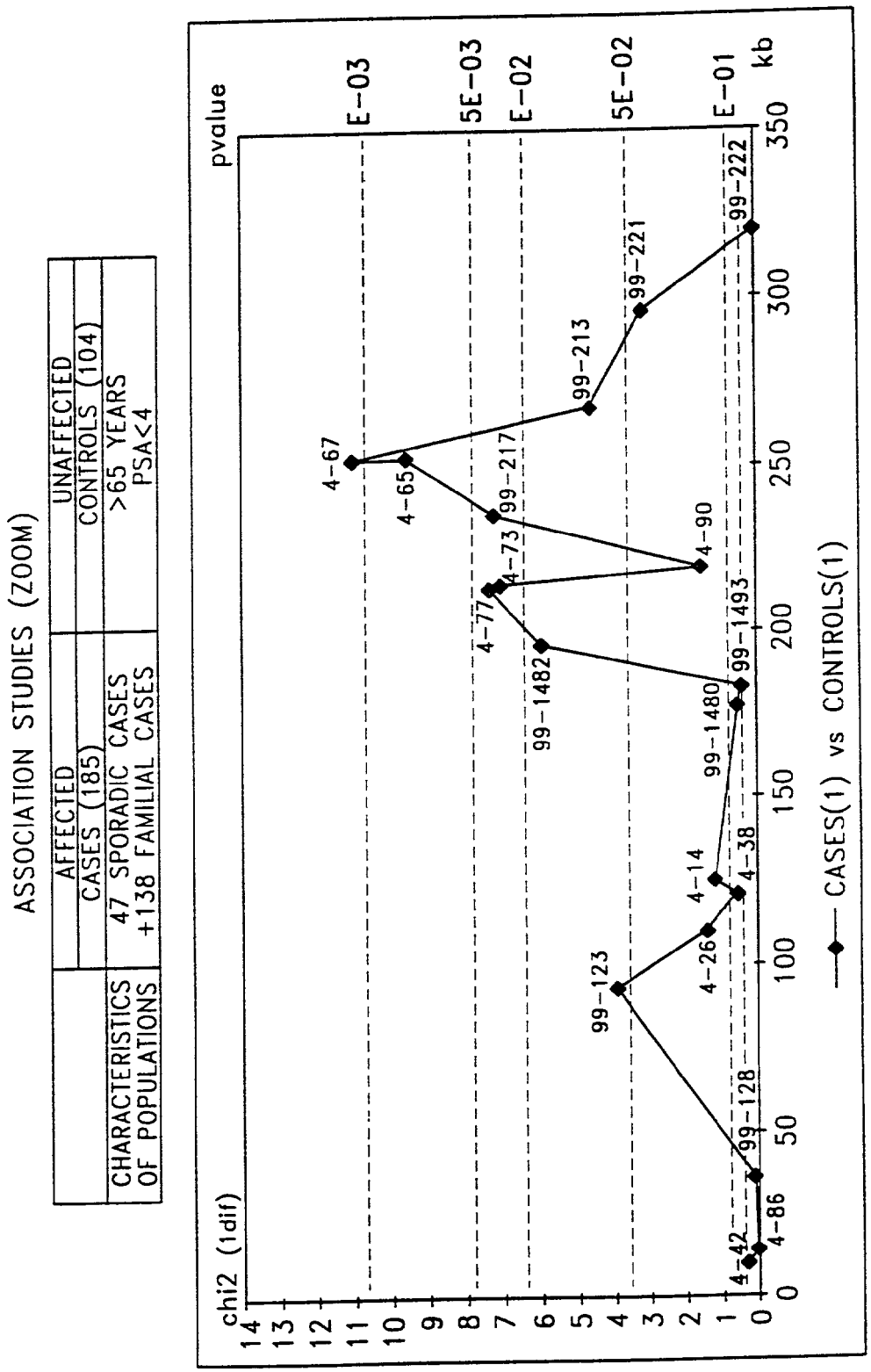
FIG. 3 is a graph showing the results of the first screening of a prostate cancer association study and the significance of various biallelic markers as measured by their chi squared and p-values for a higher density set of markers.

As shown in FIG. 3, the second phase of the analysis confirmed that the gene responsible for prostate cancer was near the biallelic marker designated 4-67, most probably within a ca. 150 kb region comprising the marker.

Haplotype Analysis

The allelic frequencies of each of the alleles of biallelic markers 99-123, 4-26, 4-14, 4-77, 99-217, 4-67, 99-213, 99-221, and 99-135 (SEQ ID NOs: 21–38) were determined in the affected and unaffected populations. Table 1 lists the internal identification numbers of the markers used in the haplotype analysis (SEQ ID NOs: 21–38), the alleles of each marker, the most frequent allele in both unaffected individuals and individuals suffering from prostate cancer, the least frequent allele in both unaffected individuals and individuals suffering from prostate cancer, and the frequencies of these alleles in each population.

Among all the theoretical potential different haplotypes based on 2 to 9 markers, 11 haplotypes showing a strong association with prostate cancer were selected. The results of these haplotype analyses are shown in FIG. 4.

FIGS. 2, 3, and 4 aggregate linkage analysis results with sequencing results which permitted the physical order and/or the distance between markers to be estimated.

Figure 5A:
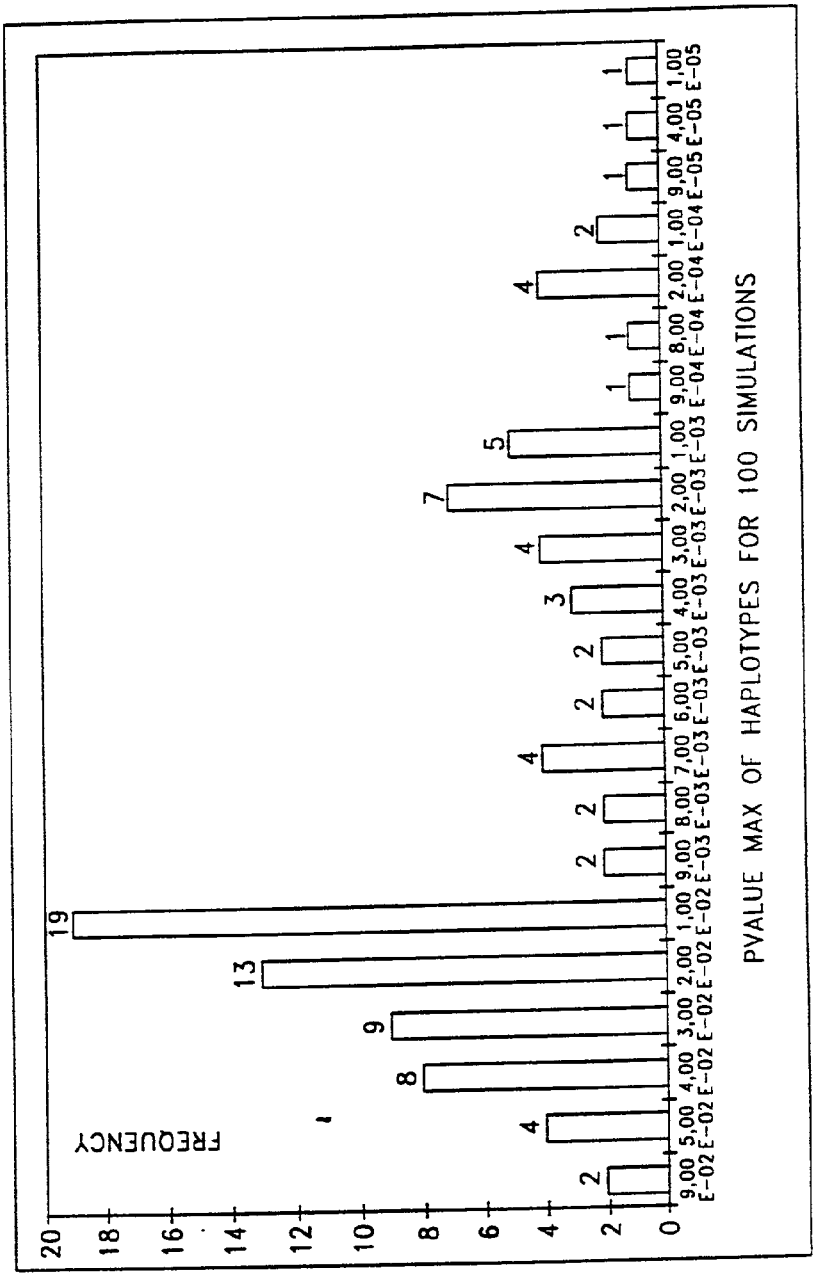
FIG. 5 is a bar graph demonstrating the results of an experiment evaluating the significance (p-values) of the haplotype analysis shown in FIG. 4.
Figure 5B:
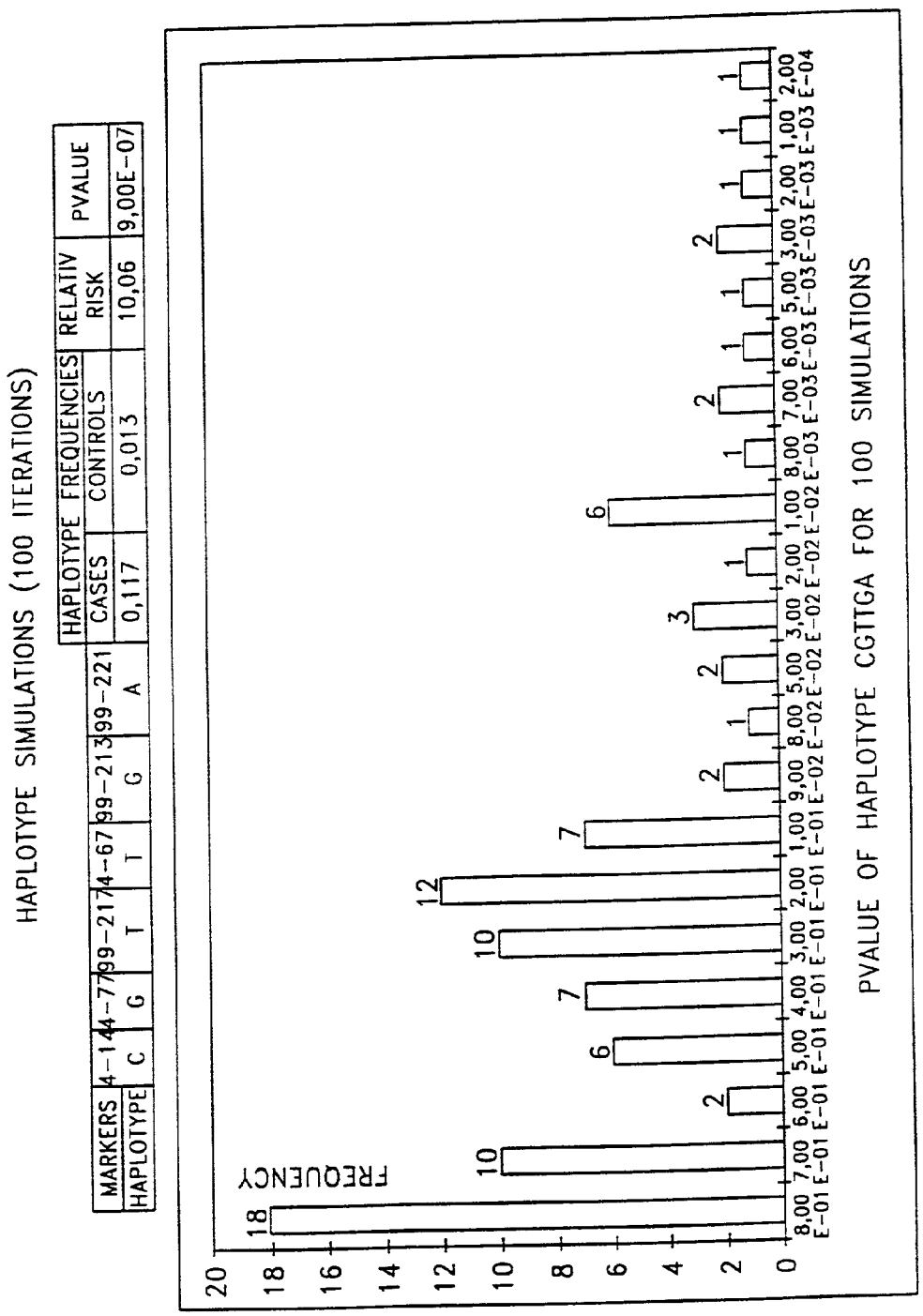

The significance of the values obtained in FIG. 4 are underscored by the following results of computer simulations. For the computer simulations, the data from the affected individuals and the unaffected controls were pooled and randomly allocated to two groups which contained the same number of individuals as the affected and unaffected groups used to compile the data summarized in FIG. 4. A haplotype analysis was run on these artificial groups for the six markers included in haplotype 5 of FIG. 4. This experiment was reiterated 100 times and the results are shown in FIG. 5. Among 100 iterations, only 5% of the obtained haplotypes are present with a p-value below $1 \times 10^{-4}$ as compared to the p-value of $9 \times 10^{-7}$ for haplotype 5 of FIG. 4. Furthermore, for haplotype 5 of FIG. 4, only 6% of the obtained haplotypes have a significance level below $5 \times 10^{-3}$ while none of them show a significance level below $5 \times 10^{-5}$.

Thus, using the data of FIG. 4 and evaluating the associations for single maker alleles or for haplotypes will permit estimation of the risk a corresponding carrier has to develop prostate cancer. Significance thresholds of relative risks will be adapted to the reference sample population used.

The diagnostic techniques may employ a variety of methodologies to determine whether a test subject has a biallelic marker pattern associated with an increased risk of developing prostate cancer or suffers from prostate cancer resulting from a mutant PG1 allele. These include any method enabling the analysis of individual chromosomes for haplotyping, such as family studies, single sperm DNA analysis or somatic hybrids.

In each of these methods, a nucleic acid sample is obtained from the test subject and the biallelic marker pattern for one or more of the biallelic markers listed in FIGS. 4, 6A and 6B is determined. The biallelic markers listed in FIG. 6A are those which were used in the haplotype analysis of FIG. 4. The first column of FIG. 6A lists the BAC clones in which the biallelic markers lie. The second column of FIG. 6A lists the internal identification number of the marker. The third column of FIG. 6A lists the sequence identification number for a first allele of the biallelic markers. The fourth column of FIG. 6A lists the sequence identification number for a second allele of the biallelic markers. For example, the first allele of the biallelic marker 99-123 has the sequence of SEQ ID NO:21 and the second allele of the biallelic marker has the sequence of SEQ ID NO: 30.

The fifth column of FIG. 6A lists the sequences of upstream primers which is used to generate amplification products containing the polymorphic bases of the biallelic markers. The sixth column of FIG. 6A lists the sequence identification numbers for the upstream primers.

The seventh column of FIG. 6A lists the sequences of downstream primers which is used to generate amplification products containing the polymorphic bases of the biallelic markers. The eighth column of FIG. 6A lists the sequence identification numbers for the downstream primers.

The ninth column of FIG. 6A lists the position of the polymorphic base in the amplification products generated using the upstream and downstream primers. The tenth column lists the identities of the polymorphic bases found at the polymorphic positions in the biallelic markers. The eleventh and twelfth columns list the locations of microsequencing primers in the biallelic markers which can be used to determine the identities of the polymorphic bases.

In addition to the biallelic markers of SEQ ID NOs: 21–38, other biallelic markers (designated 99-1482, 4-73, 4-65) have been identified which are closely linked to one or more of the biallelic markers of SEQ ID NOs: 21–38, SEQ ID NOs: 57–62, and the PG1 gene. These biallelic markers include the markers of SEQ ID NOs: 57–62, which are listed in FIG. 6B. The columns in FIG. 6B are identical to the corresponding columns in FIG. 6A. SEQ ID NOs: 58, 59, 61, and 62 lie within the PG1 gene of SEQ ID NO:1 at the positions indicated in the accompanying Sequence Listing.

Genetic analysis of these additional biallelic markers is performed as follows. Nucleic acid samples are obtained from individuals suffering from prostate cancer and unaffected individuals. The frequencies at which each of the two alleles occur in the affected and unaffected populations is determined using the methodologies described above. Association values are calculated to determine the correlation between the presence of a particular allele or spectrum of alleles and prostate cancer. The markers of SEQ ID NOs: 21–38 may also be included in the analysis used to calculate the risk factors. The markers of SEQ ID NOs: 21–38 and SEQ ID NOs: 57–62 is used in diagnostic techniques, such as those described below, to determine whether an individual is at risk for developing prostate cancer or suffers from prostate cancer as a result of a mutation in the PG1 gene.

Example 6 describes methods for determining the biallelic marker pattern.

EXAMPLE 6

A nucleic acid sample is obtained from an individual to be tested for susceptibility to prostate cancer or PG1 mediated prostate cancer. The nucleic acid sample is an RNA sample or a DNA sample.

A PCR amplification is conducted using primer pairs which generate amplification products containing the polymorphic nucleotides of one or more biallelic markers associated with prostate cancer-related forms of PG1, such as the biallelic markers of SEQ ID NOs: 21–38, SEQ ID NOs: 57–62, biallelic markers which are in linkage disequilibrium with the biallelic markers of SEQ ID NOs: 21–38, SEQ ID NOs: 57–62, biallelic markers in linkage disequilibrium with the PG1 gene, or combinations thereof. In some embodiments, the PCR amplification is conducted using primer pairs which generate amplification products containing the polymorphic nucleotides of several biallelic markers. For example, in one embodiment, amplification products containing the polymorphic bases of several biallelic markers selected from the group consisting of SEQ ID NOs: 21–38, SEQ ID NOs: 57–62, and biallelic markers which are in linkage disequilibrium with the biallelic markers of SEQ ID NOs: 21–38, SEQ ID NOs: 57–62 or with the PG1 gene is generated. In another embodiment, amplification products containing the polymorphic bases of two or more biallelic markers selected from the group consisting of SEQ ID NOs: 21–38, SEQ ID NOs: 57–62, and biallelic markers which are in linkage disequilibrium with the biallelic markers of SEQ ID NOs: 21–38, SEQ ID NOs: 57–62 or with the PG1 gene is generated. In another embodiment, amplification products containing the polymorphic bases of five or more biallelic markers selected from the group consisting of SEQ ID NOs: 21–38, SEQ ID NOs: 57–62, and biallelic markers which are in linkage disequilibrium with the biallelic markers of SEQ ID NOs: 21–38, SEQ ID NOs: 57–62 or with the PG1 gene is generated. In another embodiment, amplification products containing the polymorphic bases of more than five of the biallelic markers selected from the group consisting of SEQ ID NOs: 21–38, SEQ ID NOs: 57–62, and biallelic markers which are in linkage disequilibrium with the biallelic markers of SEQ ID NOs: 21–38, SEQ ID NOs: 57–62 or with the PG1 gene is generated.

For example, the primers used to generate the amplification products may comprise the primers listed in FIG. 6A or 6B (SEQ ID NOs: 39–56 and SEQ ID NOs: 63–68). FIG. 6A and FIG. 6B provide exemplary primers which is used in the amplification reactions and the identities and locations of the polymorphic bases in the amplification products which are produced with the exemplary primers. The sequences of each of the alleles of the biallelic markers resulting from amplification using the primers in FIGS. 6A and 6B are listed in the accompanying Sequence Listing as SEQ ID NOs:21–38 and 57–62.

The PCR primers is oligonucleotides of 10, 15, 20 or more bases in length which enable the amplification of the polymorphic site in the markers. In some embodiments, the amplification product produced using these primers is at least 100 bases in length (i.e. 50 nucleotides on each side of the polymorphic base). In other embodiments, the amplification product produced using these primers is at least 500 bases in length (i.e. 250 nucleotides on each side of the polymorphic base). In still further embodiments, the amplification product produced using these primers is at least 1000 bases in length (i.e. 500 nucleotides on each side of the polymorphic base).

It will be appreciated that the primers listed in FIGS. 6A and 6B are merely exemplary and that any other set of primers which produce amplification products containing the polymorphic nucleotides of one or more of the biallelic markers of SEQ ID NOs. 21–38 and SEQ ID NOs: 57–62 or biallelic markers in linkage disequilibrium with the sequences of SEQ ID NOs. 21–38 and SEQ ID NOs: 57–62 or with the PG1 gene, or a combination thereof is used in the diagnostic methods.

Following the PCR amplification, the identities of the polymorphic bases of one or more of the biallelic markers of SEQ ID NOs: 21–38 and SEQ ID NOs: 57–62, or biallelic markers in linkage disequilibrium with the sequences of SEQ ID NOs. 21–38 and SEQ ID NOs: 57–62 or with the PG1 gene, or a combination thereof, are determined. The identities of the polymorphic bases is determined using the microsequencing procedures described in Example 5 above and the microsequencing primers listed as features in the sequences of SEQ ID NOs: 21–38 and SEQ ID NOs: 57–62. It will be appreciated that the microsequencing primers listed as features in the sequences of SEQ ID NOs: 21–38 and SEQ ID NOs: 57–62 are merely exemplary and that any primer having a 3' end near the polymorphic nucleotide, and preferably immediately adjacent to the polymorphic nucleotide, is used. Alternatively, the microsequencing analysis is performed as described in Pastinen et al., Genome Research 7:606–614 (1997), which is described in more detail below.

Alternatively, the PCR product is completely sequenced to determine the identities of the polymorphic bases in the biallelic markers. In another method, the identities of the polymorphic bases in the biallelic markers is determined by hybridizing the amplification products to microarrays containing allele specific oligonucleotides specific for the polymorphic bases in the biallelic markers. The use of microarrays comprising allele specific oligonucleotides is described in more detail below.

It will be appreciated that the identities of the polymorphic bases in the biallelic markers is determined using techniques other than those listed above, such as conventional dot blot analyses.

Nucleic acids used in the above diagnostic procedures may comprise at least 10 consecutive nucleotides in the biallelic markers of SEQ ID NOs: 21–38 and SEQ ID NOs: 57–62 or the sequences complementary thereto. Alternatively, the nucleic acids used in the above diagnostic procedures may comprise at least 15 consecutive nucleotides in the biallelic markers of SEQ ID NOs: 21–38 and SEQ ID NOs: 57–62 or the sequences complementary thereto In some embodiments, the nucleic acids used in the above diagnostic procedures may comprise at least 20 consecutive nucleotides in the biallelic markers of SEQ ID NOs: 21–38 and SEQ ID NOs: 57–62 or the sequences complementary thereto. In still other embodiments, the nucleic acids used in the above diagnostic procedures may comprise at least 30 consecutive nucleotides in the biallelic markers of SEQ ID NOs: 21–38 and SEQ ID NOs: 57–62 or the sequences complementary thereto. In further embodiments, the nucleic acids used in the above diagnostic procedures may comprise more than 30 consecutive nucleotides in the biallelic markers of SEQ ID NOs: 21–38 and SEQ ID NOs: 57–62 or the sequences complementary thereto. In still further embodiments, the nucleic acids used in the above diagnostic procedures may comprise the entire sequence of the biallelic markers of SEQ ID NOs: 21–38 and SEQ ID NOs: 57–62 or the sequences complementary thereto.

I.E. Identification and Sequencing, of the PG1 Gene, and Localization of the PG1 Protein The above haplotype analysis indicated that 171 kb of genomic DNA between biallelic markers 4-14 and 99-221 totally or partially contains a gene responsible for prostate cancer. Therefore, the protein coding sequences lying within this region were characterized to locate the gene associated with prostate cancer. This analysis, described in further detail below, revealed a single protein coding sequence in the 171 kb, which was designated as the PG1 gene.

Template DNA for sequencing the PG1 gene was obtained as follows. BACs 189EO8 and 463FO1 were subcloned as previously described Plasmid inserts were first amplified by PCR on PE 9600 thermocyclers (Perkin-Elmer), using appropriate primers, AmpliTaqGold (Perkin-Elmer), dNTPs (Boehringer), buffer and cycling conditions as recommended by the Perkin-Elmer Corporation.

PCR products were then sequenced using automatic ABI Prism 377 sequencers (Perkin Elmer, Applied Biosystems Division, Foster City, Calif.). Sequencing reactions were performed using PE 9600 thermocyclers (Perkin Elmer) with standard dye-primer chemistry and ThermoSequenase (Amersham Life Science). The primers were labeled with the JOE, FAM, ROX and TAMRA dyes. The dNTPs and ddNTPs used in the sequencing reactions were purchased from Boehringer. Sequencing buffer, reagent concentrations and cycling conditions were as recommended by Amersham.

Following the sequencing reaction, the samples were precipitated with EtOH, resuspended in formamide loading buffer, and loaded on a standard 4% acrylamide gel. Electrophoresis was performed for 2.5 hours at 3000V on an ABI 377 sequencer, and the sequence data were collected and analyzed using the ABI Prism DNA Sequencing Analysis Software, version 2.1.2.

The sequence data obtained as described above were transferred to a proprietary database, where quality control and validation steps were performed. A proprietary base-caller ("Trace"), working using a Unix system automatically flagged suspect peaks, taking into account the shape of the peaks, the inter-peak resolution, and the noise level. The proprietary base-caller also performed an automatic trimming. Any stretch of 25 or fewer bases having more than 4 suspect peaks was considered unreliable and was discarded. Sequences corresponding to cloning vector oligonucleotides were automatically removed from the sequence. However, the resulting sequence may contain 1 to 5 bases belonging to the vector sequences at their 5' end. If needed, these can easily be removed on a case by case basis.

The genomic sequence of the PG1 gene is provided in the accompanying Sequence Listing and is designated as SEQ ID NO: 1.

Potential exons in BAC-derived human genomic sequences were located by homology searches on protein, nucleic acid and EST (Expressed Sequence Tags) public databases. Main public databases were locally reconstructed. The protein database, NRPU (Non-redundant Protein Unique) is formed by a non-redundant fusion of the Genpept (Benson D. A. et al., Nucleic Acids Res. 24: 1–5 (1996), Swissprot (Bairoch, A. and Apweiler, R, Nucleic Acids Res. 24: 21–25 (1996) and PIR/NBRF (George, D. G. et al., Nucleic Acids Res. 24:17–20 (1996) databases. Redundant data were eliminated by using the NRDB software (Benson et al., supra) and internal repeats were masked with the XNU software (Benson et al., supra). Homologies found using the NRPU database allowed the identification of sequences corresponding to potential coding exons related to known proteins.

The EST local database is composed by the gbest section (1–9) of GenBank (Benson et al., supra), and thus contains all publicly available transcript fragments. Homologies found with this database allowed the localization of potentially transcribed regions.

The local nucleic acid database contained all sections of GenBank and EMBL (Rodriguez-Tome, P. et al., Nucleic Acids Res. 24: 6–12 (1996) except the EST sections. Redundant data were eliminated as previously described.

Similarity searches in protein or nucleic acid databases were performed using the BLAS software (Altschul, S. F. et al., J. Mol. Biol. 215: 403–410 (1990). Alignments were refined using the Fasta software, and multiple alignments used Clustal W. Homology thresholds were adjusted for each analysis based on the length and the complexity of the tested region, as well as on the size of the reference database.

Potential exon sequences identified as above were used as probes to screen cDNA libraries. Extremities of positive clones were sequenced and the sequence stretches were positioned on the genomic sequence of SEQ ID NO:1. Primers were then designed using the results from these alignments in order to enable the PG1 cloning procedure described below.

Cloning PG1 cDNA

PG1 cDNA was obtained as follows. 4 μl of ethanol suspension containing 1 mg of human prostate total RNA (Clontech laboratories, Inc., Palo Alto, USA; catalogue N. 64038-1, lot 7040869) was centrifuged, and the resulting pellet was air dried for 30 minutes at room temperature.

First strand cDNA synthesis was performed using the AdvantageTM RT-for-PCR kit (Clontech laboratories, Inc., Palo Alto, USA; catalogue N. K1402-1). 1 μl of 20 mM solution of primer PGRT32: TTTTTTTTTTTTTTTTTTTTGAAAT (SEQ ID NO:10) was added to 12.5 μl of RNA solution in water, heated at 74° C. for two and a half minutes and rapidly quenched in an ice bath. 10 μl of 5×RT buffer (50 mM Tris-HCl, pH 8.3, 75 mM KCl, 3 mM MgCl2), 2.5 μl of dNTP mix (10 mM each), 1.25 μl of human recombinant placental RNA inhibitor were mixed with 1 ml of MMLV reverse transcriptase (200 units). 6.5 μl of this solution were added to RNA-primer mix and incubated at 42° C. for one hour. 80 μl of water were added and the solution was incubated at 94° C. for 5 minutes.

5 μl of the resulting solution were used in a Long Range PCR reaction with hot start, in 50 μl final volume, using 2 units of rtTHXL, 20 pmol/μl of each of GC1.5p.1: CTGTC-CCTGGTGCTCCACACGTACTC (SEQ ID NO:6) or GC1.5p2 TGGTGCTCCACACGTACTCCATGCGC (SEQ ID NO: 7) and GC1.3p: CTTGCCTGCTGGAGACACA-GAATTTCGATAGCAC (SEQ ID NO:9) primers with 35 cycles of elongation for 6 minutes at 67° C. in thermocycler.

The sequence of the PG1 cDNA obtained as described above (SEQ ID NO 3) is provided in the accompanying Sequence Listing. Results of Northern blot analysis of prostate mRNAs support the existence of a major PG1 cDNA having a 5–6 kb length.

Characterization of the PG1 Gene

The intron/exon structure of the gene was deduced by aligning the mRNA sequence from the cDNA of SEQ ID NO:3 and the genomic DNA sequence of SEQ ID NO: 1.

Figure 8:
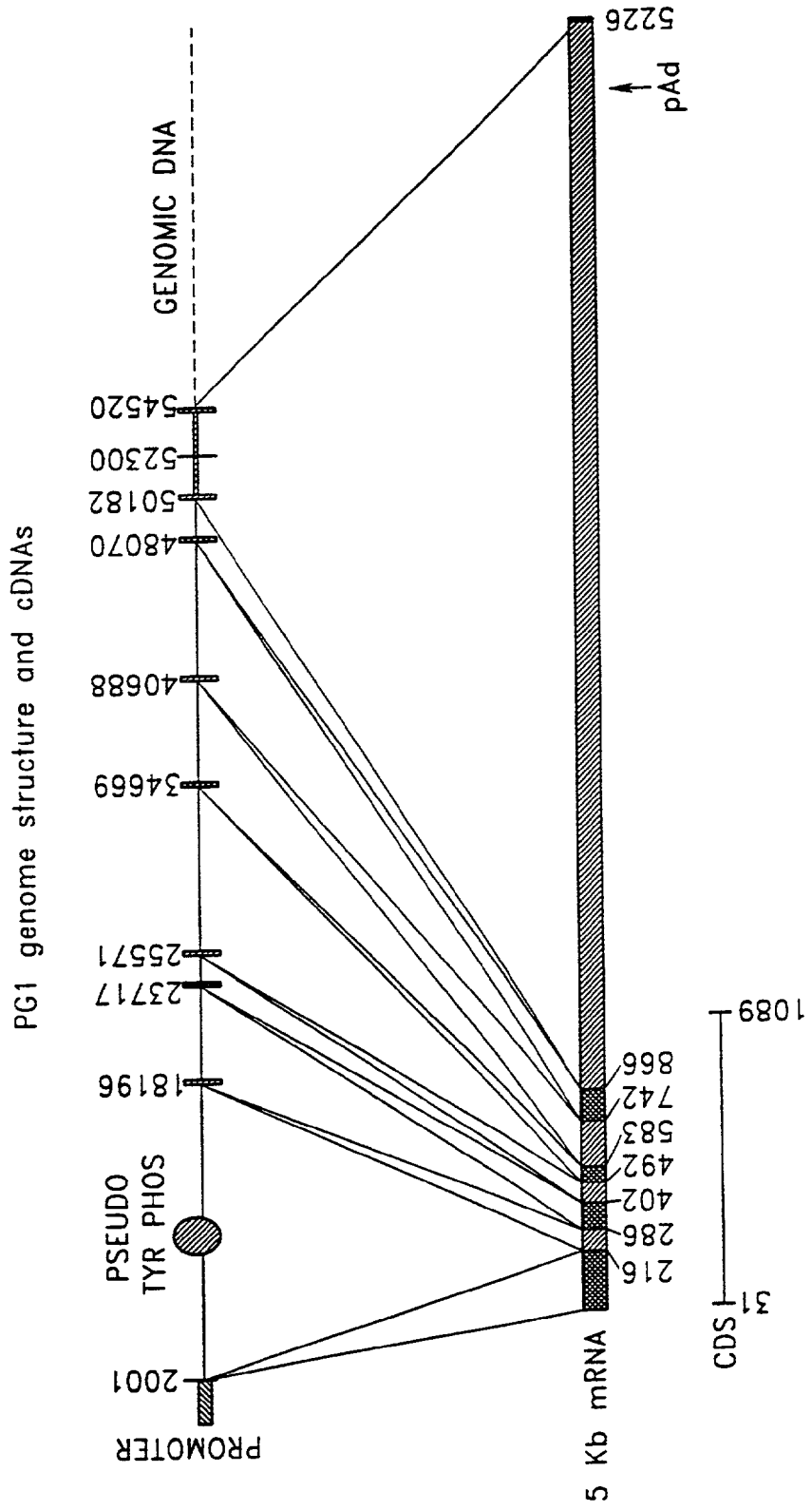
FIG. 8A is a diagram showing the genomic structure of PG1 in comparison with its most abundant mRNA transcript.
FIG. 8B is a more detailed diagram showing the genomic structure of PG1, including exons and introns.
Figure 8B:
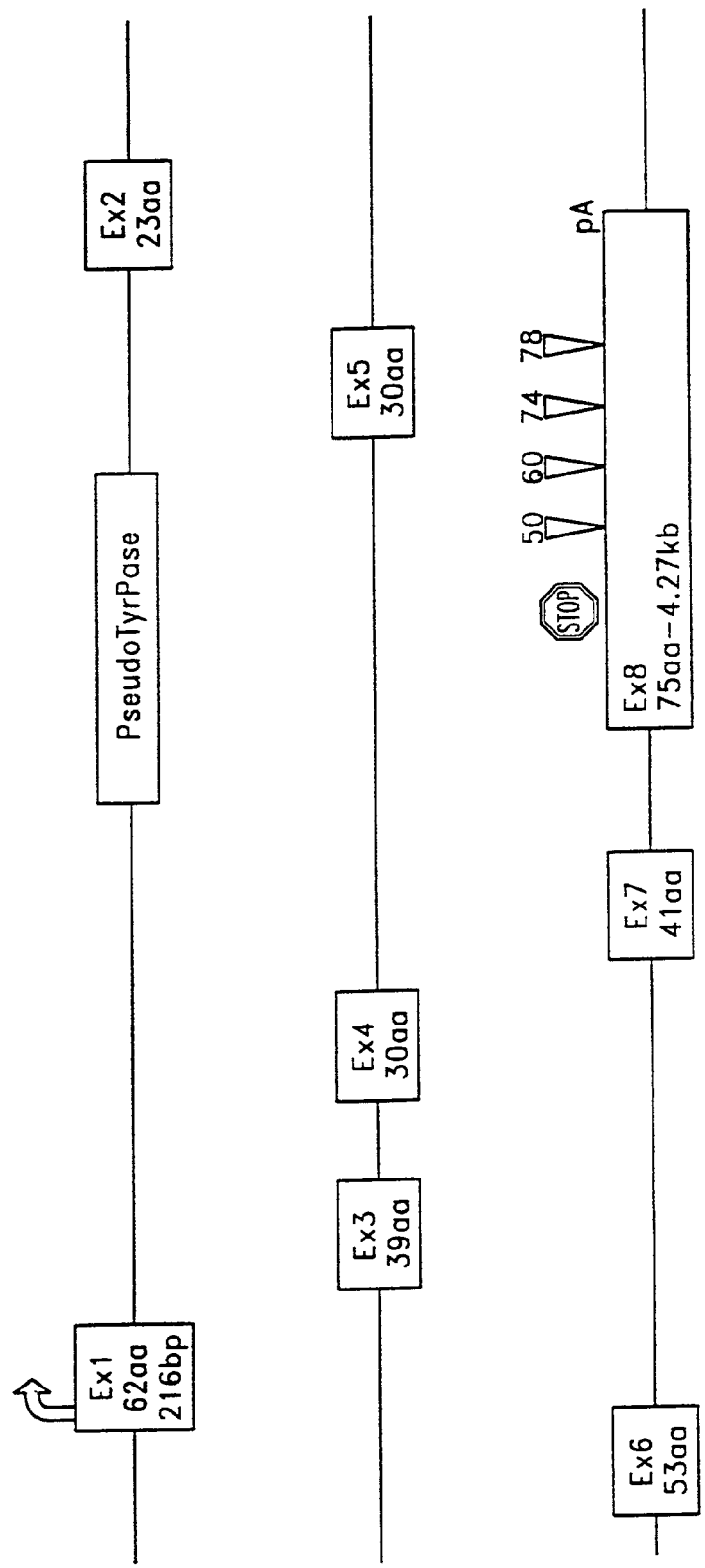

The positions of the introns and exons in the PG1 genomic DNA are provided in FIGS. 7 and 8. FIG. 7 lists positions of the start and end nucleotides defining each of the at least 8 exons (labeled Exons A-H) in the sequence of SEQ ID NO: 1, the locations and phases of the 5' and 3' splice sites in the sequence of SEQ ID NO: 1, the position of the stop codon in the sequence of SEQ ID NO: 1, and the position of the polyadenylation site in the sequence of SEQ ID NO: 1. FIG. 8 shows the positions of the exons within the PG1 genomic DNA and the PG1 mRNA, the location of a tyrosine phosphatase retro-pseudogene in the PG1 genomic DNA, the positions of the coding region in the mRNA, and the locations of the polyadenylation signal and polyA stretch in the mRNA.

As indicated in FIGS. 7 and 8, the PG1 gene comprises at least 8 exons, and spans more than 52 kb. The first intron contains a tyrosine phosphatase retropseudogene. A G/C rich putative promoter region lies between nucleotide 1629 and 1870 of SEQ ID NO: 1. A CCAAT box is present at nucleotide 1661 of SEQ ID NO: 1. The promoter region was identified as described in Prestridge, D. S., Predicting Pol II Promoter Sequences Using Transcription Factor Binding Sites, J. Mol. Biol. 249:923–932 (1995).

It is possible that the methionine listed as being the initiating methionine in the PG1 protein sequence of SEQ ID NO: 4 (based on the cDNA sequence of SEQ ID NO: 3) may actually be downstream but in phase with another methionine which acts as the initiating methionine. The genomic DNA sequence of SEQ ID NO: 1 contains a methionine upstream from the methionine at position number 1 of the protein sequence of SEQ ID NO: 4. If the upstream methionine is in fact the authentic initiation site, the sequence of the PG1 protein would be that of SEQ ID NO: 5. This possibility is investigated by determining the exact position of the 5' end of the PG1 mRNA as follows.

One way to determine the exact position of the 5' end of the PG1 mRNA is to perform a 5' RACE reaction using the Marathon-Ready human prostate cDNA kit from Clontech (Catalog. No. PT1156-1). For example, the RACE reaction may employ the PG1 primers PG15RACE196 CAATATCTGGACCCCGGTGTAATTCTC (SEQ ID NO: 8) as the first primer. The second primer in the RACE reaction is PG15RACE130n having the sequence GGTCGTCCAGCGCTTGGTAGAAG (SEQ ID NO: 2). The sequence analysis of the resulting PCR product, or the product obtained with other PG1 specific primers, will give the exact sequence of the initiation point of the PG1 transcript.

Alternatively, the 5' sequence of the PG1 transcript can be determined by conducting a PCR amplification with a series of primers extending from the 5' end of the presently identified coding region. In any event, the present invention contemplates use of PG1 nucleic acids and/or polypeptides coding for or corresponding to either SEQ ID NO:4 or SEQ ID NO:5 or fragments thereof.

It is also possible that alternative splicing of the PG1 gene may result in additional translation products not described above. It is also possible that there are sequences upstream or downstream of the genomic sequence of SEQ ID NO: 1 which contribute to the translation products of the gene. Finally, alternative promoters may result in PG1 derived transcripts other than those described herein.

The promoter activity of the region between nucleotides 1629 and 1870 can be verified as described below. Alternatively, should this region lack promoter activity, the promoter responsible for driving expression of the PG1 gene is identified as described below.

Genomic sequences lying upstream of the PG1 gene are cloned into a suitable promoter reporter vector, such as the pSEAP-Basic, pSEAP-Enhancer, pβgal-Basic, pβgal-Enhancer, or pEGFP-1 Promoter Reporter vectors available from Clontech. Briefly, each of these promoter reporter vectors include multiple cloning sites positioned upstream of a reporter gene encoding a readily assayable protein such as secreted alkaline phosphatase, β galactosidase, or green fluorescent protein. The sequences upstream of the PG1 coding region are inserted into the cloning sites upstream of the reporter gene in both orientations and introduced into an appropriate host cell. The level of reporter protein is assayed and compared to the level obtained from a vector which lacks an insert in the cloning site. The presence of an elevated expression level in the vector containing the insert with respect to the control vector indicates the presence of a promoter in the insert. If necessary, the upstream sequences can be cloned into vectors which contain an enhancer for augmenting transcription levels from weak promoter sequences. A significant level of expression above that observed with the vector lacking an insert indicates that a promoter sequence is present in the inserted upstream sequence.

Promoter sequences within the upstream genomic DNA is further defined by constructing nested deletions in the upstream DNA using conventional techniques such as Exonuclease III digestion. The resulting deletion fragments can be inserted into the promoter reporter vector to determine whether the deletion has reduced or obliterated promoter activity. In this way, the boundaries of the promoters is defined. If desired, potential individual regulatory sites within the promoter is identified using site directed mutagenesis or linker scanning to obliterate potential transcription factor binding sites within the promoter individually or in combination. The effects of these mutations on transcription levels is determined by inserting the mutations into the cloning sites in the promoter reporter vectors.

Sequences within the PG1 promoter region which are likely to bind transcription factors is identified by homology to known transcription factor binding sites or through conventional mutagenesis or deletion analyses of reporter plasmids containing the promoter sequence. For example, deletions is made in a reporter plasmid containing the promoter sequence of interest operably linked to an assayable reporter gene. The reporter plasmids carrying various deletions within the promoter region are transfected into an appropriate host cell and the effects of the deletions on expression levels is assessed. Transcription factor binding sites within the regions in which deletions reduce expression levels is further localized using site directed mutagenesis, linker scanning analysis, or other techniques familiar to those skilled in the art.

The promoters and other regulatory sequences located upstream of the PG1 gene is used to design expression vectors capable of directing the expression of an inserted gene in a desired spatial, temporal, developmental, or quantitative manner. For example, since the PG1 promoter is presumably active in the prostate, it can be used to construct expression vectors for directing gene expression in the prostate.

Preferably, in such expression vectors, the PG1 promoter is placed near multiple restriction sites to facilitate the cloning of an insert encoding a protein for which expression is desired downstream of the promoter, such that the promoter is able to drive expression of the inserted gene. The promoter is inserted in conventional nucleic acid backbones designed for extrachromosomal replication, integration into the host chromosomes or transient expression. Suitable backbones for the present expression vectors include retroviral backbones, backbones from eukaryotic episomes such as SV40 or Bovine Papilloma Virus, backbones from bacterial episomes, or artificial chromosomes.

Preferably, the expression vectors also include a polyA signal downstream of the multiple restriction sites for directing the polyadenylation of mRNA transcribed from the gene inserted in the expression vector.

Nucleic acids encoding proteins which interact with sequences in the PG1 promoter is identified using one-hybrid systems such as those described in the manual accompanying the Matchmaker One-Hybrid System kit available from Clontech (Catalog No. K1603-1). Briefly, the Matchmaker One-hybrid system is used as follows. The target sequence for which it is desired to identify binding proteins is cloned upstream of a selectable reporter gene and integrated into the yeast genome. Preferably, multiple copies of the target sequences are inserted into the reporter plasmid in tandem.

A library comprised of fusions between cDNAs to be evaluated for the ability to bind to the promoter and the activation domain of a yeast transcription factor, such as GAL4, is transformed into the yeast strain containing the integrated reporter sequence. The yeast are plated on selective media to select cells expressing the selectable marker linked to the promoter sequence. The colonies which grow on the selective media contain genes encoding proteins which bind the target sequence. The inserts in the genes encoding the fusion proteins are further characterized by sequencing. In addition, the inserts is inserted into expression vectors or in vitro transcription vectors. Binding of the polypeptides encoded by the inserts to the promoter DNA is confirmed by techniques familiar to those skilled in the art, such as gel shift analysis or DNAse protection analysis.

Analysis of PG1 Protein Sequence

The PG1 cDNA of SEQ ID NO: 3 encodes a 353 amino-acid protein (SEQ ID NO:4). As indicated in the accompanying Sequence Listing, a Prosite analysis indicated that the PG1 protein has a leucine zipper motif, a potential glycosylation site, 3 potential casein kinase II phosphorylation sites, a potential cAMP dependent protein kinase phosphorylation site, 2 potential tyrosine kinase phosphorylation sites, 4 potential protein kinase C phosphorylation sites, 5 potential N-myristoylation sites, 1 potential tyrosine sulfation site, and one potential amidation site.

A search for membrane associated domains was conducted according to the methods described in Argos, P. et al., Structural Prediction of Membrane-bound Proteins, Elur. J. Biochem. 128:565–575 (1982); Klein et al., Biochimica & Biophysica Acta 815:468–476 (1985); and Eisenberg et al., J. Mol. Biol. 179:125–142 (1984). The search revealed 5 potential transmembrane domains predicted to be integral membrane domains. These results suggest that the PG1 protein is likely to be membrane-associated and is an integral membrane protein.

A homology search was conducted to identify proteins homologous to the PG1 protein. Several proteins were identified which share homology with the PG1 protein. FIG. 9 lists the accession numbers of several proteins which share homology with the PG1 protein in three regions designated box1, box2 and box3.

It will be appreciated that each of the motifs described above is also present in the protein of SEQ ID NO: 5, which would be produced if by translation initiation translated from the potential upstream methionine in the nucleic acid of SEQ ID NO: 1.

As indicated in FIG. 9, a distinctive pattern of homology to box 1, box 2 (SEQ ID NOs: 11–14) and box 3 (SEQ ID NOs: 15–20) is found amongst acyl glyerol transferases. For example, the plsC protein from E. coli (Accession Number P26647) shares homology with the box1 and box2 sequences, but not the box 3 sequence, of the PG1 protein. The product of this gene transfers acyl from acyl-coenzymeA to the sn2 position of 1-Acyl-sn-glycerol-3-phosphate (lysophosphatidic acid, LPA)(Coleman J., Mol Gen Genet. 1992 Mar. 1; 232(2): 295–303).

Box1 and box2 homologies, but not box 3 homologies, are also found in the SLCI gene product from baker's yeast (Accession Number P33333) and the mouse gene AB005623. Each of these genes are able to complement in vivo mutations in the bacterial plsC gene. (Nagiec M M, Wells G B, Lester R L, Dickson R C, J. Biol. Chem., 1993 Oct. 15; 268(29): 22156–22163, A suppressor gene that enables Saccharomyces cerevisiae to grow without making sphingolipids encodes a protein that resembles an Escherichia coli fatty acyltransferase; and Kume K, Shimizu T, Biochem. Biophys. Res. Commun. 1997, Aug. 28; 237(3): 663–666, cDNA cloning and expression of murine 1-acyl-sn-glycerol-3-phosphate acyltransferase).

Recently two different human homologues of the mouse AB005623 gene, Accession Numbers U89336 and U56417 were cloned and found to be localized to human chromosomes 6 and 9 (Eberhardt. C., Gray, P. W. and Tjoelker, L. W., J. Biol. Chem. 1997; 272, 20299–20305, Human lysophosphatidic acid acyltransferase cDNA cloning, expression, and localization to chromosome 9q34.3; and West, J., Tompkins, C. K., Balantac, N., Nudelman, E., Meengs, B., White, T., Bursten, S., Coleman, J., Kumar, A., Singer, J. W. and Leung, D. W, DNA Cell Biol. 6, 691–701 (1997), Cloning and expression of two human lysophosphatidic acid acyltransferase cDNAs that enhance cytokine induced signaling responses in cells).

The enzymatic acylation of LPA results in 1,2-diacyl-sn-glycerol 3-phosphate, an intermediate to the biosynthesis of both glycerophospholipids and triacylglycerol. Several important signaling messengers participating in the transduction of mitogenic signals, induction of apoptosis, transmission of nerve impulses and other cellular responses mediated by membrane bound receptors belong to this metabolic pathway.

LPA itself is a potent regulator of mammalian cell proliferation. In fact, LPA is one of the major mitogens found in blood serum. (For a review: Durieux M E, Lynch K R, Trends Pharmacol. Sci. 1993 June; 14(6):249–254, Signaling properties of lysophosphatidic acid. LPA can act as a survival factor to inhibit apoptosis of primary cells; and Levine J S, Koh J S, Triaca V, Lieberthal W, Am. J. Physiol. 1997 October; 273(4Pt2): F575–F585, Lysophosphatidic acid: a novel growth and survival factor for renal proximal tubular cells). This function of LPA is mediated by the lipid kinase phosphatidylinositol 3-kinase.

Phosphatidylinositol and its derivatives present another class of messengers emerging from the 1-acyl-sn-glycerol-3-phosphate acyltransferase pathway. (Toker A, Cantley L C, Nature 1997 Jun. 12; 387(6634): 673–676, Signaling through the lipid products of phosphoinositide-3-OH kinase; Martin T F, Curr. Opin. Neurobiol. 1997 June; 7(3):331–338, Phosphoinositides as spatial regulators of membrane traffic; and Hsuan J J, et al., Int. J. Biochem. Cell Biol. 1997 Mar. 1$^{st}$; 29(3): 415–435, Growth factor-dependent phosphoinositide signaling).

Cell growth, differentiation and apoptosis can be affected and modified by enzymes involved in this metabolic pathway. Consequently, alteration of this pathway could facilitate cancer cell progression. Modulation of the activity of enzymes in this pathway using agents such as enzymatic inhibitors could be a way to restore a normal phenotype to cancerous cells.

Ashagbley A, Samadder P, Bittman R, Erukulla R K, Byun H S, Arthur G have recently shown that ether-linked analogue of lysophosphatidic acid: 4-O-hexadecyl-3(S)—O-methoxybutanephosphonate can effectively inhibit the proliferation of several human cancerous cell lines, including DU145 line of prostate cancer origin. (Anticancer Res 1996 July; 16(4A): 1813–1818, Synthesis of ether-linked analogues of lysophosphatidate and their effect on the proliferation of human epithelial cancer cells in vitro).

Structural differences between the PG1 family of cellular proteins and the functionally confirmed 1-acyl-sn-glycerol-3-phosphate acyltransferase family, evidenced by the existence of a different pattern of homology to box3, could point to unique substrate specificity in the phospholipid metabolic pathway, to specific interaction with other cellular components or to both.

Further analysis of the function of the PG1 gene can be conducted, for example, by constructing knockout mutations in the yeast homologues of the PG1 gene in order to elucidate the potential function of this protein family, and to test potential substrate analogs in order to revert the malignant phenotype of human prostate cancer cells as described in Section VIII, below.

EXAMPLE 7

Analysis of the Intracellular Localisation of the PG1 Isoforms

To study the intracellular localisation of PG1 protein, different isoforms of PG1 were cloned in the expression vector pEGFP-N1(Clontech), transfected and expressed in normal (PNT2A) or adenocarcinoma (PC3) prostatic cell line.

First, to generate cDNA inserts, 5' and 3' primers were synthesised allowing to amplify different regions of the PG1 open reading frame. Respectively, these primers were designed with an internal EcoRI or BamHI site which allowed the insertion of the amplified product into the EcoRI and BamHI sites of the expression vector. The restriction sites were introduced into the primer so that after cloning into pEGFP-N1, the PG1 open reading frame would be fused in frame, to the EGFP open reading frame. The translated protein would be a fusion between PG1 and EGFP. EGFP being a variant form of the GFP protein (Green Fluorescent Protein), it is possible to detect the intracellular localisation of the different PG1 isoforms by examining the fluorescence emitted by the EGFP fused protein.

The different forms that were analysed correspond either to different messengers identified by RT-PCR performed on total normal human prostatic RNA or to a truncated form resulting from a non sense mutation identified in a tumoural prostatic cell line LnCaP. The different PG1 constructions were transfected using the lipofectine technique and EGFP expression was examined 20 hours post transfection.

Name and Description of the Different Forms Transfected are Listed Below:

A) PG1 includes all the coding exons from exon 1 to 8.

B) PG1/1-4 corresponds to an alternative messenger which is due to an alternative splicing, joining exon 1 to exon 4, and resulting in the absence of exons 2 and 3.

C) PG1/1-5 corresponds to an alternative messenger which is due to an alternative splicing, joining exon 1 to exon 5, and resulting in the absence of exons 2, 3 and 4.

D) PG1/1-7 includes exons 1 to 6, and corresponds to the mutated form identified in genomic DNA of the prostatic tumoural cell line LNCaP.

Cloning of the PG1 cDNA Inserts in the EGFP-N1 Expression Vector cDNAs from human prostate were obtained by RT-PCR using the Advantage RT-for-PCR Kit (CLONTECH ref K1402-2). First, 1 µl of oligodT-containing PG1 specific primer PGRT32 TTTTTTTTTTTTTTTTTTTGAAAT (20 pmoles) and 11.5 µl of DEPC treated H₂O were added to 1 µl of total mRNA (1 µg) extracted from human prostate (CLONTECH ref 64038-1). The mRNA was heat denaturated for 2.5 min at 74° C. and then quickly chilled on ice. A mix containing 4 µl of 5× buffer, 1 µl of dNTPs (10 mM each), 0.5 µl of recombinant RNase inhibitor (20 U) and 1 µl of MoMuLV Reverse Transcriptase (200 U) was added to the denaturated mRNA. Reverse transcription was performed for 60 min. at 42° C. Enzymes were heat denaturated for 5 min. at 94° C. Then, 80 µl of DEPC treated H₂O were added to the reaction mix and the cDNA mix was stored at −20° C. Primers PG15Eco3 (5' CCT GAATTCCGCCGAGCTGAGAAGATGC 3'), and PG13Bam2 (5' CCT GGATCCGCTTTAATAGTAACCCACAGGCAG 3') were used for PCR amplification of the different PG1 cDNAs. A 50 µl PCR reaction mix containing 5 µl of the previously prepared prostate cDNA mix, 15 µl of 3.3×PCR buffer, 4 µl of dNTPs (2.5 mM each), 20 pmoles of primer PG15Eco3, 20 pmoles of primer PG13Bam2, 1 µl of RtthXL enzyme, 2.2 µl Mg(OAc)₂ (Hot Start) was set up and amplification was performed for 35 cycles of 30 sec at 94° C., 10 min. at 72° C., 4 min. at 67° C. after an initial denaturation step of 10 min. at 94° C. Size and integrity of the PCR product was assessed by migration on a 1% agarose gel. 2 µg of the amplification product were digested with 2.4 units of EcoRI (PROMEGA ref R601A) and 2.0 units of BamHI (PROMEGA ref R602A) in 50 µl of 1× Multicore buffer for 2 hours at 37° C. Enzymes were then heat inactivated for 20 min, at 68° C., DNA was phenol/chloroform extracted and ethanol-precipitated and its concentration was estimated by migration on a 1% agarose gel.

To prepare the vector, 2 µg of pEGFP-N1 vector (CLONTECH ref 6085-1) were digested with 2.4 units of EcoRI (PROMEGA ref R601A) and 2.0 units of BamHI (PROMEGA ref R602A) in 50 µl of 1× multicore buffer for 2 hours at 37° C. Enzymes were then heat inactivated for 20 min, at 68° C., DNA was phenol/chloroform extracted and ethanol-precipitated and its concentration and integrity were estimated by migration on a 1% agarose gel. 20 ng of the BamHI and EcoRI digested pEGFP-N1 vector were added to 50 ng of BamHI-EcoRI digested PG1 cDNAs. Ligation was performed over night at 13° C. using 0.5 units of T4 DNA ligase (BOEHRINGER ref 84333623) in a final volume of 20 µl containing 1× ligase buffer. The ligation reaction mix was desalted by dialysis against water (MILLIPORE ref VSWP01300) for 30 min. at room temperature. One fifth of the desalted ligation reaction was electroporated in 25 µl of competent cells ElectroMAX DH10B (GIBCO BRL ref 18290-015) using a resistance of 126 Ohms, capacitance of 50 µF, and voltage of 2.5 KV. Bacteria were then incubated in 500 µl of SOB medium for 30 min at 37° C. One fifth was plated on LB AGAR containing 40 µg/µl KANAMYCINE (SIGMA ref K4000) and incubated over night at 37° C. Plasmid DNA was prepared from an overnight liquid culture of individual colonies and sequenced. Among the different forms identified 3 were used:

A) PG1 which includes all the coding exons from exon 1 to 8.

B) PG1/1-4 which corresponds to an alternative messenger which is due to an alternative splicing, joining exon 1 to exon 4, and resulting in the absence of exons 2 and 3.

C) PG1/1-5 which corresponds to an alternative messenger which is due to an alternative splicing, joining exon 1 to exon 5, and resulting in the absence of exons 2, 3 and 4.

D) Vector PG1/1-7: A cDNA insert encoding for a truncated protein was synthesized by PCR amplification, using primers PG15Eco3 and PG1mut29Bam (5' CCT GGATCCCCTCCATCGTCTTTCCCTT 3') and vector PG1 as a template. The resulting PCR product was cloned following the same protocol as described above.

Transfection of the PG1 Expression Vectors in Human Prostate Cell Lines.

The DNA/lipofectin solution was prepared as followed: 1.5 µl of lipofectin (GIBCO BRL ref 18292-011) was diluted in 100 µl of OPTI-MEM medium (GIBCO BRL ref 31985-018), and incubated for 30 min. at room temperature before being mixed to 0.5 µg of vector diluted in 100 µl of OPTI-MEM medium and incubated for 15 min. at room temperature. Cells were inoculated in RPMI1640 medium (Gibco BRL ref 61870-010) containing 5% fetal calf serum (Dutscher ref P30-3302) on slides (NUNC Lab-Tek ref 177402A) and grown at 37° C. in 5% CO₂ Cells reaching 40–60% confluency were rinsed with 300 µl OPTI-MEM medium and incubated with the DNA/lipofectin solution for 6 hours at 37° C. The medium containing DNA was replaced by medium supplemented in fetal calf serum and cells were incubated for at least 36 hours at 37° C. Slides were rinsed in PBS and cells were fixed in ethanol, treated with Propidium iodide, and examined with a fluorescence microscope using a double-pass filter set for FITC/PI.

Figure 10:
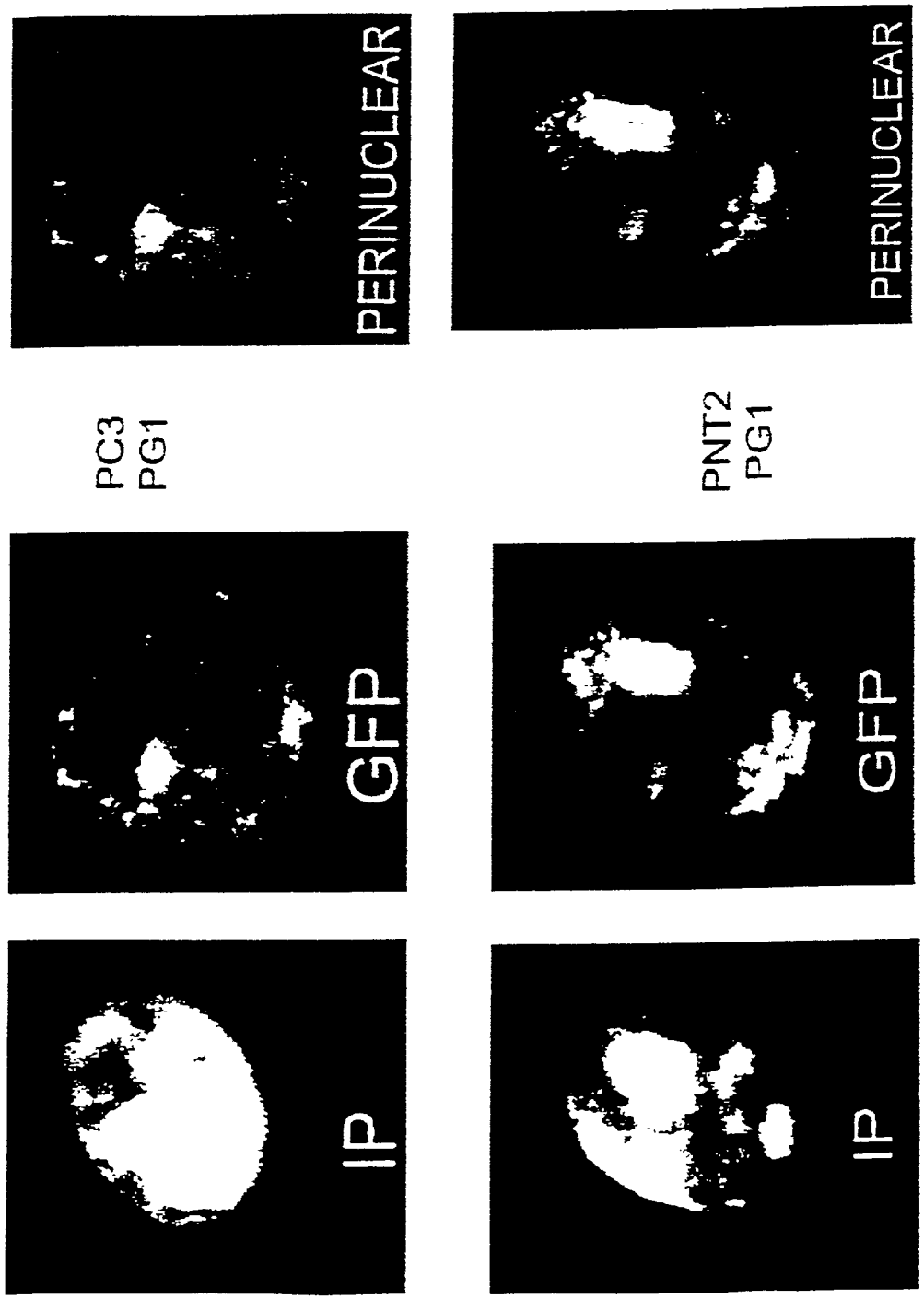
FIG. 10 is a half-tome reproduction of a fluorescence micrograph of the perinuclear/nuclear expression of PG1 in tumoral (PC3) and normal prostatic cell lines (PNT2). Vector "PG1": includes all the coding exons from exon 1 to 8. For PC3 (upper panel) and PNT2 (lower panel), the nucleus was labelled with Propidium iodide (IP, left panel). Note that EGFP fluorescence was detected in and around the nucleus (GFP, middle panel), as shown when the two pictures were overlapped (right panel).
Figure 11:
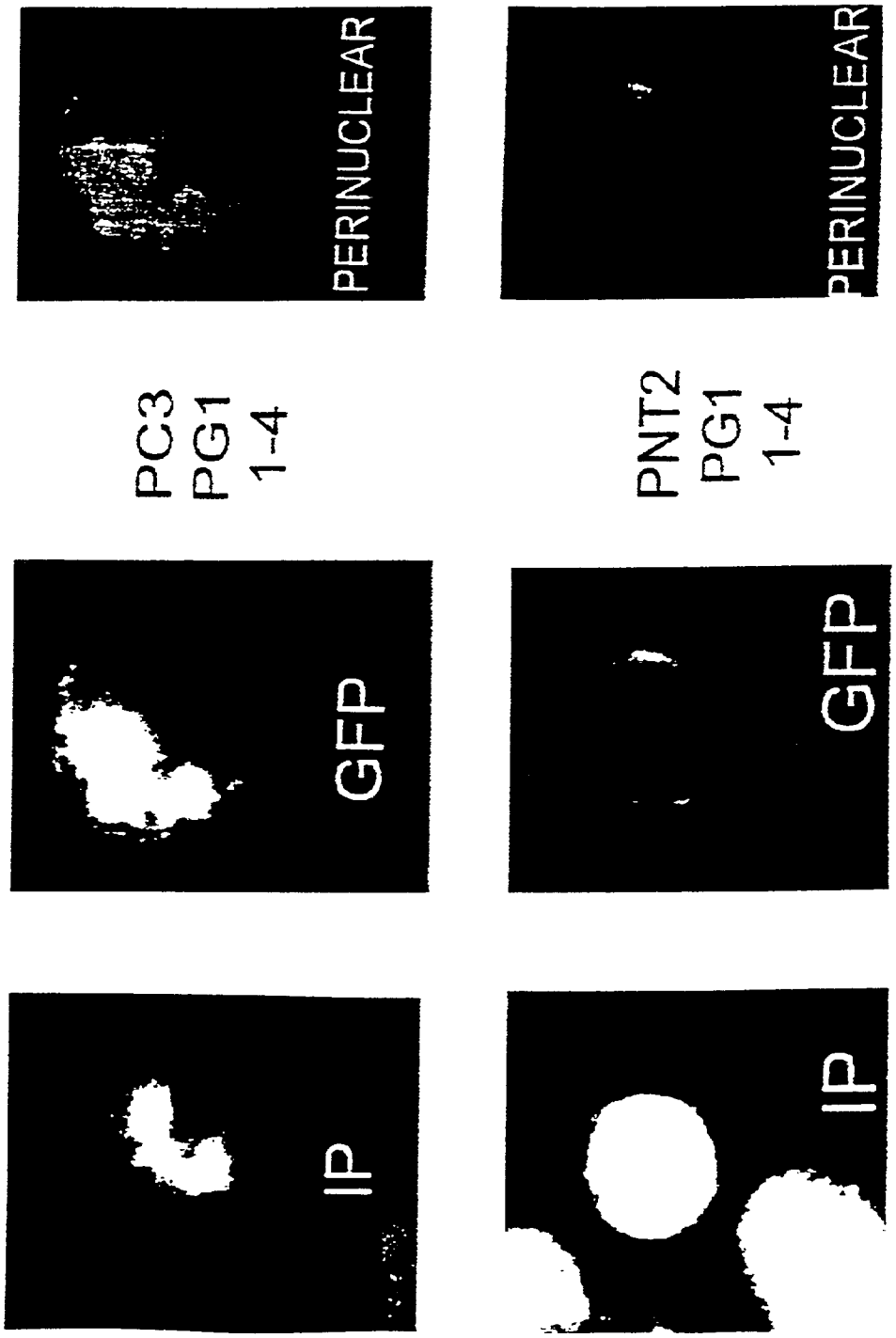
FIG. 11 is a half-tome reproduction of a fluorescence micrograph of the perinuclear/nuclear expression of PG1/1-4 in tumoral (PC3) and normal prostatic cell lines (PNT2). Vector "PG1/1-4" corresponds to an alternative messenger which is due to an alternative splicing, joining exon 1 to exon 4, and resulting in the absence of exons 2 and 3. For PC3 (upper panel) and PNT2 (lower panel), the nucleus was labelled with Propidium iodide (IP, left panel). Note that EGFP fluorescence was detected in and around the nucleus (GFP, middle panel), as shown when the two pictures were overlapped (right panel).

After transfection of PG1 and PG1/1-4 in both the normal and tumoural prostatic cell line, green fluorescence was detected into and around the nucleus (FIGS. 10 and 11). This result shows that the PG1 protein is localised in the nucleus and/or the nuclear membrane. Furthermore, it suggests that exons 2 and 3 are dispensable for translocation of PG1 to the nucleus. In addition, no difference in the intracellular localisation of these two forms was detected between the tumoral and the normal prostatic cell line.

Figure 12:
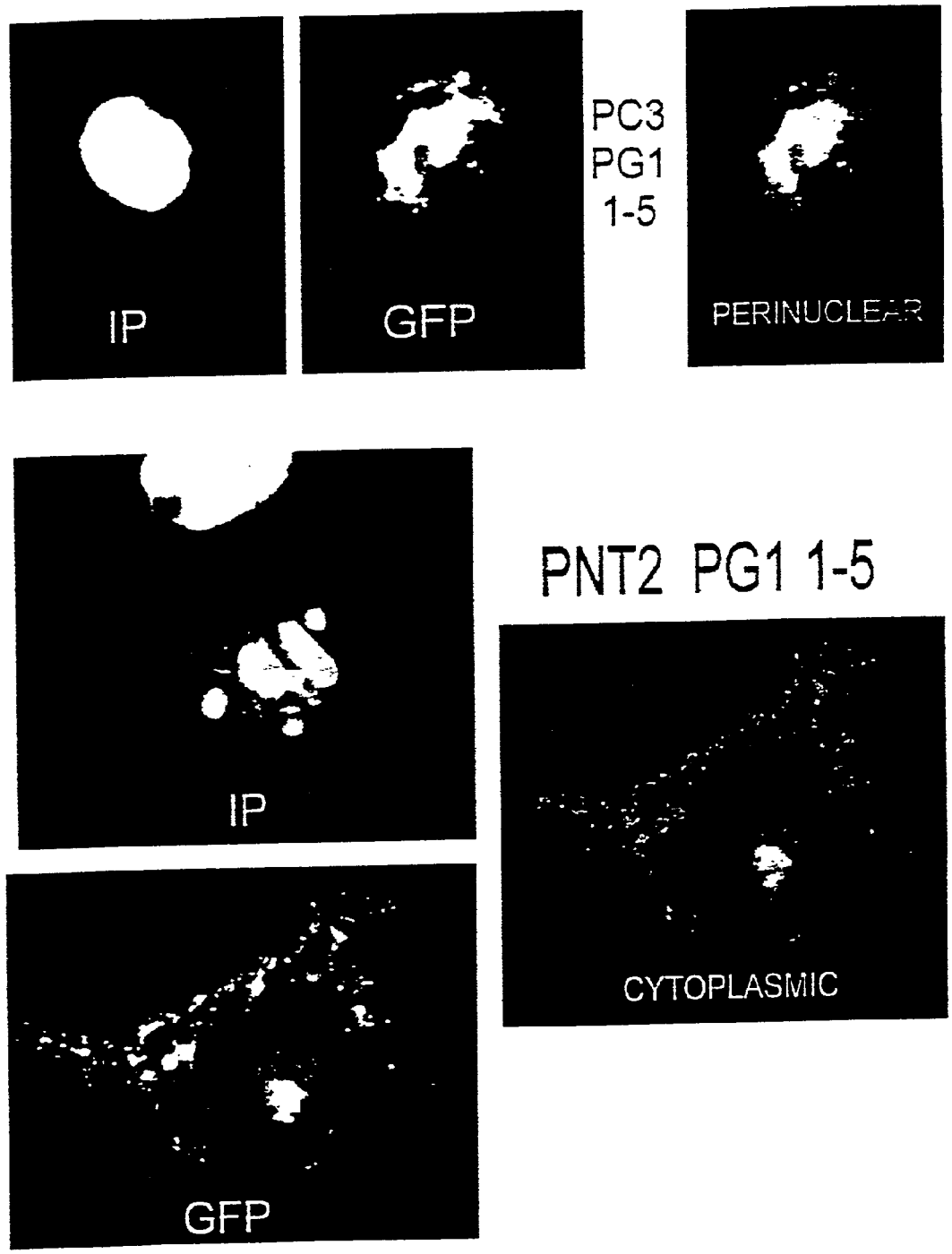
FIG. 12 is a half-tome reproduction of a fluorescence micrograph of the perinuclear/nuclear expression of PG1/1-5 in tumoral prostatic cell line (PC3) and cytoplasmic expression of PG1/1-5 in normal prostatic cell line (PNT2).

On the contrary, transfection experiments using PG1/1-5 show that this form is cytoplasmic in the normal prostatic cell line PNT2A. It suggests that exon 4 might be important for the regulation of the translocation to the nucleus. Interestingly, similar transfection experiments in the tumoral cell line PC3 show that PG1/1-5 remains nuclear and or perinuclear (FIG. 12). This result shows that there is an abnormality in the regulation of the intracellular localization of the PG1 isoforms in this tumoral cell line. Furthermore, it indicates that the normal function of PG1 can be altered indirectly in prostatic tumors by an abnormality in the regulation of its intracellular location.

Finally, a non-sense mutation has been identified in the prostatic tumoural cell line LNCaP, in exon 6 of PG1 (SEQ ID NO: 69). This mutation is responsible for the production of a truncated protein (SEQ ID NO: 70). To determine the intracellular location of this truncated protein, PG1/1-7 and PG1 were transfected in the normal prostatic cell line PNT2A. Comparison of the fluorescence detected in both sets of experiments clearly showed that the truncated form was localised in the cytoplasm as the non-truncated protein was located in and/or around the nucleus (FIG. 13). This result indicates that this mutated PG1 is translated in a truncated protein which is unable to reach the nucleus. It also suggests that exons 7 and 8 may play an important role in the regulation of the intracellular localisation of PG1. Furthermore, it supports the previous hypothesis that an altered regulation of PG1 intracellular localisation might be involved in prostate tumorigenesis.

|  | pEGFP N1 | PG1 | PG11-4 | PG11-5 | PG11-7 |
|---|---|---|---|---|---|
| Transfection PNT2 06/17/98 | NA | nuclear | nuclear | ND | ND |
| Transfection PNT2 06/30/98 | cytoplasmic | nuclear | nuclear | ND | ND |
| Transfection PNT2 07/16/98 | cytoplasmic | NA | NA | cytoplasmic | ND |
| Transfection PC3 07/16/98 | NA | nuclear | nuclear | nuclear | ND |
| Transfection PC3 07/16/98 bis | cytoplasmic | nuclear | NA | NA | ND |
| Transfection PC3 08/27/98 | cytoplasmic | nuclear | nuclear | nuclear | NA |
| Transfection PNT2 08/28/98 | cytoplasmic | nuclear | NA | cytoplasmic | cytoplasmic |
|  |  | All exons | X2-3 Spliced out | X2-3-4 Spliced out | mut aa229 |

NA: Not assessable
ND: Not done
Nuclear: localized in and around the nucleus (nuclear and perinuclear localization).

Alternative Splice Species

Alternative splicing is a common natural tool for the inhibition of function of full length gene products. Alternative splicing is known to result in enzyme isoforms, possesing different kinitec characteristics (pyruvate kinase: M1 and M2 Yamada K, Noguchi T, Biochem J. 1999 Jan. 1;337(Pt 1):1–11. Estrogen receptor (ER) gene is known to possess variant splicing yelding the deletions of exon 3, 5, or 7. The truncated ER protein induced from variant mRNA could mainly be exhibited as a repressor through dominant negative effects on normal ER protein (Iwase H, Omoto Y, Iwata H, Hara Y, Ando Y, Kobayashi S, Oncology 1998 December;55 Suppl S1:11–16 )'Yu et al (Yu J J, Mu C, Dabholkar M, Guo Y, Bostick-Bruton F, Reed E, Int J Mol Med 1998 March;1(3):617–620) demonstrated that there is an association between alternative splicing of ERCC1, and reduction in cellular capability to repair cisplatin-DNA adduct. Munoz-Sanjuan et al (Munoz-Sanjuan I, Simandl B K, Fallon J F, Nathans J, Development 1998 Dec. 14;126(Pt 2):409–421) demonstrated existence of two differentially spliced isoforms of fibroblast growth factor(FGF) type two genes that are present in non-overlapping spatial distributions in the neural tube and adjacent structures in developing chicken embryo. One of these forms is secreted and activates the expression of HoxD13, HoxD11, Fgf-4 and BMP-2 ectopically, consistent with cFHF-2 playing a role in anterior-posterior patterning of the limb.

The CD44 is a cell adhesion molecule that is present as numerous isoforms created by mRNA alternative splicing. Expression of variant isoforms of CD44 is associated with tumor growth and metastasis.(Shibuya Y, Okabayashi T, Oda K, Tanaka N, Jpn J Clin Oncol 1998 October;28(10):609–14) they showed that ratio of two particular isoforms is a useful indicator of prognosis in gastric and colorectal carcinoma. Zhang Y F et al (Zhang Y F, Jeffery S, Burchill S A, Berry P A, Kaski J C, Carter N D, Br J Cancer 1998 November;78(9):1141–6° showed that human endothelin receptor A is the subject to alternative spicing giving at least two isoforms. The truncated receptor was expressed in all tissues and cells examined, but the level of expression varied. In melanoma cell lines and melanoma tissues, the truncated receptor gene was the major species, whereas the wild-type ETA was predominant in other tissues. Zhang et al. conclude that the function and biological significance of this truncated ETA receptor is not clear, but it may have regulatory roles for cell responses to ETs.

EXAMPLE 8

Identification of PG1 Alternative Splice Species

The PG1 cDNA was first cloned by screening of a human prostate cDNA library. Sequence analysis of about 400 cDNA clones showed that at least 14 isoforms were present in this cDNA library. Comparison of their sequences to the genomic sequence showed that these isoforms resulted from a complex set of different alternative splicing events between numerous exons (FIG. 14).

To rule out the possibility of a cloning artefact generated during the cDNA library construction and to systematically identify all existing alternative splice junctions, RT-PCR experiments were performed on RNA of normal prostate as well as normal prostatic cell lines PNT1A, PNT1B and PNT2 using all the possible combinations of primers specific to the different exon borders SEQ ID NOs: 137–178. The presence of multiple PCR bands in each reaction was assessed by migration in an agarose gel. Each band was analysed by sequencing, and the presence or absence of specific splicing events, as seen in the sequence by a specific splice junction, was scored as plus or minus in FIG. 15.

Furthermore, to identify aberrant splicing event in prostate tumors, similar experiments were performed on RNA extracted from tumoral prostatic cell lines LnCaP (obtained from two different sources and named FCG and JMB), CaHPV, Du145 and PC3 as well as on RNA obtained from prostate tumors (ECP5 to ECP24).

As shown in the first five columns, all isoforms identified in the cDNA library were detected in RNA of normal prostate, normal prostatic cell lines or prostate tumors. In addition to the different splice junctions detected in the cDNA library, 19 other splice junctions were detected in normal prostate or in normal prostatic cell lines. Two types of exon junctions (exons 3-7, exons 3b-8) were never detected in either normal prostate, normal prostatic cell lines, prostate tumors or prostatic tumoral cell lines. Comparison between normal and tumoral samples showed the presence of 2 additional exon junctions (exons 3-8, exons 5-8) in the tumoral samples that were not detected previously in the normal samples. This result demonstrate that during tumorigenesis, the complex regulation of the PG1 splicing has been altered, resulting in an abnormal ratio of the different isoforms. It is of a specific interest since it has been shown in patients with a genetic predisposition to Wilms tumor, that an imbalance between different RNA isoforms might be involved in tumorigenesis (Bickmore et al., Science 1992, 257:325–7; Little et al, Hum Mol Genet 1995, 4:351–8).

Interestingly, comparison between normal and tumoral samples, also showed that some exon junctions are present in all normal samples, but are absent in numerous tumoral samples. It further indicates that the normal function of PG1 can be altered by an abnormality in the regulation of PG1 splicing and further support the previous hypothesis.

Furthermore, comparison between the different types of normal samples (Col.2 versus Col. 3, 4 and 5) also showed differences in the presence or absence of some exon junctions. It indicates that the transformation process necessary to the generation of these normal prostatic cell lines might result in similar alteration which further support the previous hypothesis.

EXAMPLE 9

Determining the Tumor Supressor Activity of the PG1 Gene Product, Mutants and Other PG1 Polypeptides PG1 variants which results from either alternate splicing of the PG1 mRNA or from mutation of PG1 that introduce a stop codon (nucleotide of SEQ ID NO: 69 and protein of SEQ ID NO: 70) can no longer perform its role of tumor suppressor. It is possible and even likely that PG1 tumor suppressor role extends beyond prostate cancer to other form of malignancies. PG1 therefore represent a prime candidate for gene therapy of cancer by creating a targeting vector which knocks out the mutant and/or introduces a wild-type PG1 gene (e.g. SEQ ID NO 3 or 179) or a fragment thereof.

To validate this model, PG1 and its alternatively spliced or mutated variants are stably transfected in tumor cell line using methods described in Section VIII. The efficiency of transfection is determined by northern and western blotting; the latter is performed using antibodies prepared against PG1 synthetic peptides designed to distinguish the product of the most abundant PG1 mRNA from the alternatively spliced variants, the truncated variant, or other functional mutants. The production of synthetic peptides and of polyclonal antibodies is performed using the methods described herein in Sections III and VII. After demonstrating that PG1 and its variant are efficiently expressed in various tumor cell line preferably derived from human prostate cancer, hepatocarcinoma, lung and colon carcinoma; we the effect of this gene on the rate of cell division, DNA synthesis, ability to grow in soft agar and ability to induce tumor progression and metastasis when injected in immunologically deficient nude mice are determined.

Alternatively the PG1 gene and its variant are inserted in adenoviruses that are used to obtain a high level of expression of these genes. This method is preferred to test the effect of PG1 expression in animal that are spontaneously developing tumor. The production of specific adenoviruses is obtained using methods familiar to those with normal skills in cell and molecular biology.

II. Polynucleotides:

The present invention encompasses polynucleotides in the form of PG1 genomic or cDNA as well as polynucleotides for use as primers and probes in the methods of the invention. These polynucleotides may consist of, consist essentially of, or comprise a contiguous span of nucleotides of a sequence from any sequence in the Sequence Listing as well as sequences which are complementary thereto ("compléments thereof"). Preferably said sequence is selected from SEQ ID NOs: 3, 112–125, 179, 182–184. The "contiguous span" is at least 6, 8, 10, 12, 15, 20, 25, 30, 50, 100, 200, or 500 nucleotides in length. It should be noted that the polynucleotides of the present invention are not limited to having the exact flanking sequences surrounding the polymorphic bases which are enumerated in Sequence Listing. Rather, it will be appreciated that the flanking sequences surrounding the biallelic markers, or any of the primers of probes of the invention which are more distant from a biallelic markers, is lengthened or shortened to any extent compatible with their intended use and the present invention specifically contemplates such sequences. It will be appreciated that the polynucleotides referred to in the Sequence Listing is of any length compatible with their intended use. Also the flanking regions outside of the contiguous span need not be homologous to native flanking sequences which actually occur in humans. The addition of any nucleotide sequence, which is compatible with the nucleotides intended use is specifically contemplated. The contiguous span may optionally include the PG1-related biallelic marker in said sequence. Optionally either allele of the biallelic markers described above in the definition of PG1-related biallelic marker is specified as being present at the PG1-related biallelic marker.

The invention also relates to polynucleotides that hybridize, under conditions of high or intermediate stringency, to a polynucleotide of a sequence from any sequence in the Sequence Listing as well as sequences, which are complementary thereto. Preferably said sequence is selected from SEQ ID NOs: 3, 112–125, 179, 182–184. Preferably such polynucleotides is at least 6, 8, 10, 12, 15, 20, 25, 30, 35, 40, 50, 60, 70, 80, 90, 100, 200, or 500 nucleotides in length. Preferred polynucleotides comprise an PG1-related biallelic marker. Optionally either allele of the biallelic markers described above in the definition of PG1-related biallelic marker is specified as being present at the biallelic marker site. Conditions of high and intermediate stringency are further described in Section X.C.4, below.

The invention embodies polynucleotides which encode an entire human, mouse or mammalian PG1 protein, or fragments thereof. Generally the polynucleotides of the invention comprise the naturally occurring nucleotide sequence of the PG1. However, any naturally occurring silent codon variation or other silent codon variation can be employed to encode the PG1 amino acids sequence. As for those amino acids which are changed or added to the PG1 gene for any embodiment of the invention which requires the expression of a nucleotide sequence, the nucleic acid sequences generally will be chosen to optimize expression in the specific human or non-human animal system in which the polynucleotide is intended to be used, making use of known codon preferences. The PG1 polynucleotides of the invention can be the native nucleotide sequence which encodes a human, mouse, or mammalian PG1 protein, preferably the PG1 polynucleotide sequence of SEQ ID NOs: 3, 112–125, 179, 182–184, and the compliments thereof. The polynucleotides of the invention include those which encode PG1 polypeptides with a contiguous stretch of at least 8, 10, 12, 15, 20, 25, 30, 50, 100 or 200 amino acids from SEQ ID NOs: 4, 5, 70, 74, and 125–136, as well as any other human, mouse or mammalian PG1 polypeptide. In addition the present invention encompasses polynucleotides which comprise a contiguous stretch of at least 8, 10, 12, 15, 20, 25, 30, 50, 100, 200, 500 nucleotides of a human, mouse or mammalian PG1 genomic sequence as well as complete human, mouse, or mammalian PG1 genes, preferably of SEQ ID NOs: 179, 182, 183, and the compliments thereof.

The present invention encompasses polynucleotides which consist of, consist essentially of, or comprise a contiguous stretch of at least 8, 10, 12, 15, 20, 25, 30, 50, 100, 200, or 500 nucleotides of a human, mouse or mammalian PG1 cDNA sequences as well as an entire human, mouse, or mammalian PG1 cDNA. The cDNA species and polynucleotide fragments comprised by the polynucleotides of the invention include the predominant species derived from any human, mouse or mammal source, preferably SEQ ID NOs: 3, 184, and the compliments thereof. In addition, the polynucleotides of the invention comprise cDNA species, and fragments thereof, that result from the alternative splicing of PG1 transcripts in any human, mouse or other mammal, preferably the cDNA species of SEQ ID NOs: 112–124, and compliments thereof. Moreover, the invention encompasses cDNA species and other polynucleotides which consist of or comprise the polynucleotides which span a splice junction, preferably including any one of SEQ ID NOs: 137 to 178, and the compliments thereof; more preferably any one of SEQ ID NOs: 137 to 149, 151 to 169, 171 to 178, and the compliments thereof. The polynucleotides of the invention also include cDNA and other polynucleotides which comprise two covalently linked PG1 exons, derived from a single human, mouse or mammalian species, immediately adjacent to one another in the order shown, and selected from the following pairs of PG1 exons: 1:2, 1:3, 1:4, 1:5, 1:6, 1:7, 1:8, 2:3, 2:4, 2:5, 2:6, 2:7, 2:8, 3:4, 3:5, 3:6, 3:7, 3:8,4:5, 4:6,4:7, 4:8, 5:6, 5:7, 5:8, 6:7, 6:8, 7:8, 1:1bis, 1bis:2, 1bis:3, 1bis:4, 1bis:5, 1bis:6, 1bis:7, 1bis:8, 3:3bis, 3bis:4, 3bis:5, 3bis:6, 3bis:7, 3bis:8, 5:5bis, 5bis:6, 5bis:7, 5bis:8, 1:6bis, 2:6bis, 3:6bis, 4:6bis, 5:6bis, 6bis:7, 6bis:8, and the compliments thereof. In a preferred embodiment the sequences of the PG1 exons in each of the pairs of exons is selected as follows:

exon 1—SEQ ID NO: 100; exon 2—SEQ ID NO: 101; exon 3—SEQ ID NO: 102; exon 4—SEQ ID NO: 103; exon 5—SEQ ID NO: 104; exon 6—SEQ ID NO: 105; exon 7—SEQ ID NO: 106; exon 8—SEQ ID NO: 107; exon 1bis—SEQ ID NO: 108; exon 3bis—SEQ ID NO: 109; exon 5bis—SEQ ID NO: 110; and exon 6bis—SEQ ID NO: 111. Because of the 8 different polyadenylation sites in exon 8, any cDNA or polynucleotide of the invention comprising a human cDNA fragment encompassing exon 8 is truncated such that only the first 330 nucleotides, 699 nucleotides, 833 nucleotides, 1826 nucleotides, 2485 nucleotides, 2805 nucleotides, 4269 nucleotides or 4315 nucleotides of exon 8 shown in SEQ ID NO: 107 are present.

The primers of the present invention is designed from the disclosed sequences for any method known in the art. A preferred set of primers is fashioned such that the 3' end of the contiguous span of identity with the sequences of the Sequence Listing is present at the 3' end of the primer. Such a configuration allows the 3' end of the primer to hybridize to a selected nucleic acid sequence and dramatically increases the efficiency of the primer for amplification or sequencing reactions. Allele specific primers is designed such that a biallelic marker is at the 3' end of the contiguous span and the contiguous span is present at the 3' end of the primer. Such allele specific primers tend to selectively prime an amplification or sequencing reaction so long as they are used with a nucleic acid sample that contains one of the two alleles present at a biallelic marker. The 3' end of primer of the invention is located within or at least 2, 4, 6, 8, 10, 12, 15, 18, 20, 25, 50, 100, 250, 500, or 1000 nucleotides upstream of an PG1-related biallelic marker in said sequence or at any other location which is appropriate for their intended use in sequencing, amplification or the location of novel sequences or markers.

Preferred amplification primers include the polynucleotides disclosed in SEQ ID NOs: 39–56, and 63–68. Additional preferred amplification primers for particular non-genic PG1-related biallelic markers are listed as follows by the internal reference number for the marker and the SEQ ID NOs for the PU and RP amplification primers respectively: 4-14-107 use SEQ ID NOs 339 and 382; 4-14-317 use SEQ ID NOs 339 and 382; 4-14-35 use SEQ ID NOs 339 and 382; 4-20-149 use SEQ ID NOs 340 and 383; 4-22-174 use SEQ ID NOs 341 and 384; 4-22-176 use SEQ ID NOs 341 and 384; 4-26-60 use SEQ ID NOs 342 and 385; 4-26-72 use SEQ ID NOs 342 and 385; 4-3-130 use SEQ ID NOs 343 and 386; 4-38-63 use SEQ ID NOs 344 and 387; 4-38-83 use SEQ ID NOs 344 and 387; 4-4-152 use SEQ ID NOs 345 and 388; 4-4-187 use SEQ ID NOs 345 and 388; 4-4-288 use SEQ ID NOs 345 and 388; 4-42-304 use SEQ ID NOs 346 and 389; 4-42-401 use SEQ ID NOs 346 and 389; 4-43-328 use SEQ ID NOs 347 and 390; 4-43-70 use SEQ ID NOs 347 and 390; 4-50-209 use SEQ ID NOs 348 and 391; 4-50-293 use SEQ ID NOs 348 and 391; 4-50-323 use SEQ ID NOs 348 and 391; 4-50-329 use SEQ ID NOs 348 and 391; 4-50-330 use SEQ ID NOs 348 and 391; 4-52-163 use SEQ ID NOs 349 and 392; 4-52-88 use SEQ ID NOs 349 and 392; 4-53-258 use SEQ ID NOs 350 and 393; 4-54-283 use SEQ ID NOs 351 and 394; 4-54-388 use SEQ ID NOs 351 and 394; 4-55-70 use SEQ ID NOs 352 and 395; 4-55-95 use SEQ ID NOs 352 and 395; 4-56-159 use SEQ ID NOs 353 and 396; 4-56-213 use SEQ ID NOs 353 and 396; 4-58-289 use SEQ ID NOs 354 and 397; 4-58-318 use SEQ ID NOs 354 and 397; 4-60-266 use SEQ ID NOs 355 and 398; 4-60-293 use SEQ ID NOs 355 and 398; 4-84-241 use SEQ ID NOs 356 and 399; 4-84-262 use SEQ ID NOs 356 and 399; 4-86-206 use SEQ ID NOs 357 and 400; 4-86-309 use SEQ ID NOs 357 and 400; 4-88-349 use SEQ ID NOs 358 and 401; 4-89-87 use SEQ ID NOs 359 and 402; 99-123-184 use SEQ ID NOs 360 and 403; 99-128-202 use SEQ ID NOs 361 and 404; 99-128-275 use SEQ ID NOs 361 and 404; 99-128-313 use SEQ ID NOs 361 and 404; 99-128-60 use SEQ ID NOs 361 and 404; 99-12907-295 use SEQ ID NOs 362 and 405; 99-130-58 use SEQ ID NOs 363 and 406; 99-134-362 use SEQ ID NOs 364 and 407; 99-140-130 use SEQ ID NOs 365 and 408; 99-1462-238 use SEQ ID NOs 366 and 409; 99-147-181 use SEQ ID NOs 367 and 410; 99-1474-156 use SEQ ID NOs 368 and 411; 99-1474-359 use SEQ ID NOs 368 and 411; 99-1479-158 use SEQ ID NOs 369 and 412; 99-1479-379 use SEQ ID NOs 369 and 412; 99-148-129 use SEQ ID NOs 370 and 413; 99-148-132 use SEQ ID NOs 370 and 413; 99-148-139 use SEQ ID NOs 370 and 413; 99-148-140 use SEQ ID NOs 370 and 413; 99-148-182 use SEQ ID NOs 370 and 413; 99-148-366 use SEQ ID NOs 370 and 413; 99-148-76 use SEQ ID NOs 370 and 413; 99-1480-290 use SEQ ID NOs 371 and 414; 99-1481-285 use SEQ ID NOs 372 and 415; 99-1484-101 use SEQ ID NOs 373 and 416; 99-1484-328 use SEQ ID NOs 373 and 416; 99-1485-251 use SEQ ID NOs 374 and 417; 99-1490-381 use SEQ ID NOs 375 and 418; 99-1493-280 use SEQ ID NOs 376 and 419; 99-151-94 use SEQ ID NOs 377 and 420; 99-211-291 use SEQ ID NOs 378 and 421; 99-213-37 use SEQ ID NOs 379 and 422; 99-221-442 use SEQ ID NOs 380 and 423; 99-222-109 use SEQ ID NOs 381 and 424; and the compliments thereof.

Primers with their 3' ends located 1 nucleotide upstream or downstream of a PG1-related biallelic marker have a special utility in microsequencing assays. Preferred microsequencing primers include the polynucleotides from position 1 to position 23 and from position 25 to position 47 of SEQ ID NOs: 21–38, and as well as the compliments thereof. Additional preferred microsequencing primers for particular non-genic PG1-related biallelic markers are listed as follows by the internal reference number for the marker and the SEQ ID NOs of the two preferred microsequencing primers: 4-14-107 of SEQ ID NOs 425 and 502*; 4-14-317 of SEQ ID NOs 426 and 503*; 4-14-35 of SEQ ID NOs 427 and 504*; 4-20-149 of SEQ ID NOs 428* and 505; 4-20-77 of SEQ ID NOs 429 and 506; 4-22-174 of SEQ ID NOs 430* and 507; 4-22-176 of SEQ ID NOs 431 and 508; 4-26-60 of SEQ ID NOs 432 and 509*; 4-26-72 of SEQ ID NOs 433 and 510; 4-3-130 of SEQ ID NOs 434 and 511*; 4-38-63 of SEQ ID NOs 435 and 512; 4-38-83 of SEQ ID NOs 436 and 513*; 4-4-152 of SEQ ID NOs 437 and 514; 44-187 of SEQ ID NOs 438* and 515; 4-4-288 of SEQ ID NOs 439 and 516; 442-304 of SEQ ID NOs 440 and 517; 4-42-401 of SEQ ID NOs 441* and 518; 443-328 of SEQ ID NOs 442 and 519; 4-43-70 of SEQ ID NOs 443* and 520; 4-50-209 of SEQ ID NOs 444* and 521; 4-50-293 of SEQ ID NOs 445* and 522; 4-50-323 of SEQ ID NOs 446* and 523; 4-50-329 of SEQ ID NOs 447* and 524; 4-50-330 of SEQ ID NOs 448 and 525; 4-52-163 of SEQ ID NOs 449* and 526; 4-52-88 of SEQ ID NOs 450* and 527; 4-53-258 of SEQ ID NOs 451 and 528*;4-54-283 of SEQ ID NOs 452* and 529; 4-54-388 of SEQ ID NOs 453 and 530; 4-55-70 of SEQ ID NOs 454 and 531*; 4-55-95 of SEQ ID NOs 455* and 532; 4-56-159 of SEQ ID NOs 456* and 533; 4-56-213 of SEQ ID NOs 457 and 534; 4-58-289 of SEQ ID NOs 458* and 535; 4-58-318 of SEQ ID NOs 459* and 536; 4-60-266 of SEQ ID NOs 460* and 537; 4-60-293 of SEQ ID NOs 461* and 538; 4-84-241 of SEQ ID NOs 462 and 539*; 4-84-262 of SEQ ID NOs 463 and 540; 4-86-206 of SEQ I) NOs 464 and 541*; 4-86-309 of SEQ ID NOs 465 and 542; 4-88-349 of SEQ ID NOs 466 and 543.; 4-89-87 of SEQ ID NOs 467* and 544.; 99-123-184 of SEQ ID NOs 468 and 545; 99-128-202 of SEQ ID NOs 469 and 546; 99-128-275 of SEQ ID NOs 470 and 547; 99-128-313 of SEQ ID NOs 471 and 548; 99-128-60 of SEQ ID NOs 472* and 549; 99-12907-295 of SEQ ID NOs 473 and 550*; 99-130-58 of SEQ ID NOs 474* and 551 *; 99-134-362 of SEQ ID NOs 475 and 552*; 99-140-130 of SEQ ID NOs 476* and 553*; 99-1462-238 of SEQ ID NOs 477* and 554; 99-147-181 of SEQ ID NOs 478 and 555*; 99-1474-156 of SEQ ID NOs 479 and 556*; 99-1474-359 of SEQ ID NOs 480 and 557; 99-1479-158 of SEQ ID NOs 481* and 558; 99-1479-379 of SEQ ID NOs 482 and 559; 99-148-129 of SEQ ID NOs 483 and 560; 99-148-132 of SEQ ID NOs 484 and 561; 99-148-139 of SEQ ID NOs 485 and 562; 99-148-140 of SEQ ID NOs 486 and 563; 99-148-182 of SEQ ID NOs 487 and 564*; 99-148-366 of SEQ ID NOs 488 and 565; 99-148-76 of SEQ ID NOs 489 and 566; 99-1480-290 of SEQ ID NOs 490 and 567*; 99-1481-285 of SEQ ID NOs491 and 568*; 99-1484-101 of SEQ ID NOs 492 and 569; 99-1484-328 of SEQ ID NOs 493* and 570; 99-1485-251 of SEQ ID NOs494 and 571*; 99-1490-381 of SEQ ID NOs 495* and 572; 99-1493-280 of SEQ ID NOs 496 and 573*; 99-151-94 of SEQ ID NOs 497 and 574*; 99-211-291 of SEQ ID NOs 498* and 575; 99-213-37 of SEQ ID NOs 499 and 576; 99-221442 of SEQ ID 500 and 577; 99-222-109 of SEQ ID NOs 501* and 578; and compliments thereof.

Additional preferred microsequencing primers for particular genic PG1-related biallelic markers include a polynucleotide selected from the group consisting of the nucleotide sequences from position N–X to position N–1 of SEQ ID NO:179, nucleotide sequences from position N+1 to position N+X of SEQ ID NO:179, and the compliments thereof, wherein X is equal to 15, 18, 20, 25, 30, or a range of 15 to 30, and N is equal to one of the following values: 2159; 2443; 4452; 5733; 8438; 11843; 1983; 12080; 12221; 12947; 13147; 13194; 13310; 13342; 13367; 13594; 13680; 13902; 16231; 16388; 17608; 18034; 18290; 18786; 22835; 22872; 25183; 25192; 25614; 26911; 32703; 34491; 34756; 34934; 35160; 39897; 40598; 40816; 40947; 45783; 47929; 48206; 48207; 49282; 50037; 50054; 50101; 50220; 50440; 50562; 50653; 50660; 50745; 50885; 51249; 51333; 51435; 51468; 51515; 51557; 51566; 51632; 51666; 52016; 52096; 52151; 52282; 52348; 52410; 52580; 52712; 52772; 52860; 53092; 53272; 53389; 53511; 53600; 53665; 53815; 54365; and 54541.

The probes of the present invention is designed from the disclosed sequences for any method known in the art, particularly methods which allow for testing if a particular sequence or marker disclosed herein is present. A preferred set of probes is designed for use in the hybridization assays of the invention in any manner known in the art such that they selectively bind to one allele of a biallelic marker, but not the other under any particular set of assay conditions. Preferred hybridization probes may consists of, consist essentially of, or comprise a contiguous span which ranges in length from 8, 10, 12, 15, 18 or 20 to 25, 35, 40, 50, 60, 70, or 80 nucleotides, or be specified as being 12, 15, 18, 20, 25, 35, 40, or 50 nucleotides in length and including a PG1-related biallelic marker of said sequence. Optionally either of the two alleles specified in the definition of PG1-realted biallelic marker is specified as being present at the biallelic marker site. Optionally, said biallelic marker is within 6, 5, 4, 3, 2, or 1 nucleotides of the center of the hybridization probe or at the center of said probe. A preferred set of hybridization probes is disclosed in SEQ ID NOs: 21–38, 57–62, 185–338, and the compliments thereof. Another particularly preferred set of hybridization probes includes the polynucleotides from position X to position Y of any one of SEQ ID NOs: 21–38, 57–62, 185–338, or the compliments thereof, wherein X is equal to 5, 8, 10, 12, 14, 16, 18 or a range of 5 to 18, and Y is equal to 30, 32, 34, 36, 38, 40, 43 or a range of 30 to 43; preferably X equals 12 and Y equals 36. Additional preferred hybridization probes for particular genic PG1-related biallelic markers include a polynucleotide selected from the group consisting of the nucleotide sequences from position N–X to position N+Y of SEQ ID NO:179, and the compliments thereof, wherein X is equal to 8, 10, 12, 15, 20, 25, or a range of 8 to 30, Y is equal to 8, 10, 12, 15, 20, 25, or a range of 8 to 30, and N is equal to one of the following values: 2159; 2443; 4452; 5733; 8438; 11843; 1983; 12080; 12221; 12947; 13147; 13194; 13310; 13342; 13367; 13594; 13680; 13902; 16231; 16388; 17608; 18034; 18290; 18786; 22835; 22872; 25183; 25192; 25614; 26911; 32703; 34491; 34756; 34934; 35160; 39897; 40598; 40816; 40947; 45783; 47929; 48206; 48207; 49282; 50037; 50054; 50101; 50220; 50440; 50562; 50653; 50660; 50745; 50885; 51249; 51333; 51435; 51468; 51515; 51557; 51566; 51632; 51666; 52016; 52096; 52151; 52282; 52348; 52410; 52580; 52712; 52772; 52860; 53092; 53272; 53389; 53511; 53600; 53665; 53815; 54365; and 54541; wherein the nucleotide at position N is selected from one of the two alleles specified in the definition of PG1-realted biallelic marker at the biallelic marker site at position N.

Any of the polynucleotides of the present invention can be labeled, if desired, by incorporating a label detectable by spectroscopic, photochemical, biochemical, immunochemical, or chemical means. For example, useful labels include radioactive substances, fluorescent dyes or biotin. Preferably, polynucleotides are labeled at their 3' and 5' ends. A label can also be used to capture the primer, so as to facilitate the immobilization of either the primer or a primer extension product, such as amplified DNA, on a solid support. A capture label is attached to the primers or probes and can be a specific binding member which forms a binding pair with the solid's phase reagent's specific binding member (e.g. biotin and streptavidin). Therefore depending upon the type of label carried by a polynucleotide or a probe, it is employed to capture or to detect the target DNA. Further, it will be understood that the polynucleotides, primers or probes provided herein, may, themselves, serve as the capture label. For example, in the case where a solid phase reagent's binding member is a nucleic acid sequence, it is selected such that it binds a complementary portion of a primer or probe to thereby immobilize the primer or probe to the solid phase. In cases where a polynucleotide probe itself serves as the binding member, those skilled in the art will recognize that the probe will contain a sequence or "tail" that is not complementary to the target. In the case where a polynucleotide primer itself serves as the capture label, at least a portion of the primer will be free to hybridize with a nucleic acid on a solid phase. DNA Labeling techniques are well known to the skilled technician.

Any of the polynucleotides, primers and probes of the present invention can be conveniently immobilized on a solid support. Solid supports are known to those skilled in the art and include the walls of wells of a reaction tray, test tubes, polystyrene beads, magnetic beads, nitrocellulose strips, membranes, microparticles such as latex particles, sheep (or other animal) red blood cells, duracytes® and others. The solid support is not critical and can be selected by one skilled in the art. Thus, latex particles, microparticles, magnetic or non-magnetic beads, membranes, plastic tubes, walls of microtiter wells, glass or silicon chips, sheep (or other suitable animal's) red blood cells and duracytes are all suitable examples. Suitable methods for immobilizing nucleic acids on solid phases include ionic, hydrophobic, covalent interactions and the like. A solid support, as used herein, refers to any material which is insoluble, or can be made insoluble by a subsequent reaction. The solid support can be chosen for its intrinsic ability to attract and immobilize the capture reagent. Alternatively, the solid phase can retain an additional receptor which has the ability to attract and immobilize the capture reagent. The additional receptor can include a charged substance that is oppositely charged with respect to the capture reagent itself or to a charged substance conjugated to the capture reagent. As yet another alternative, the receptor molecule can be any specific binding member which is immobilized upon (attached to) the solid support and which has the ability to immobilize the capture reagent through a specific binding reaction. The receptor molecule enables the indirect binding of the capture reagent to a solid support material before the performance of the assay or during the performance of the assay. The solid phase thus can be a plastic, derivatized plastic, magnetic or non-magnetic metal, glass or silicon surface of a test tube, microtiter well, sheet, bead, microparticle, chip, sheep (or other suitable animal's) red blood cells, duracytes® and other configurations known to those of ordinary skill in the art. The polynucleotides of the invention can be attached to or immobilized on a solid support individually or in groups of at least 2, 5, 8, 10, 12, 15, 20, or 25 distinct polynucleotides of the inventions to a single solid support. In addition, polynucleotides other than those of the invention may attached to the same solid support as one or more polynucleotides of the invention.

Any polynucleotide provided herein is attached in overlapping areas or at random locations on the solid support. Alternatively the polynucleotides of the invention are attached in an ordered array wherein each polynucleotide is attached to a distinct region of the solid support which does not overlap with the attachment site of any other polynucleotide. Preferably, such an ordered array of polynucleotides is designed to be "addressable" where the distinct locations are recorded and can be accessed as part of an assay procedure. Addressable polynucleotide arrays typically comprise a plurality of different oligonucleotide probes that are coupled to a surface of a substrate in different known locations. The knowledge of the precise location of each polynucleotides location makes these "addressable" arrays particularly useful in hybridization assays. Any addressable array technology known in the art can be employed with the polynucleotides of the invention. One particular embodiment of these polynucleotide arrays is known as the Genechips™, and has been generally described in U.S. Pat. No. 5,143,854; PCT publications WO 90/15070 and 92/10092. These arrays may generally be produced using mechanical synthesis methods or light directed synthesis methods, which incorporate a combination of photolithographic methods and solid phase oligonucleotide synthesis (Fodor et al., Science, 251:767–777, 1991). The immobilization of arrays of oligonucleotides on solid supports has been rendered possible by the development of a technology generally identified as "Very Large Scale Immobilized Polymer Synthesis" (VLSIPS™) in which, typically, probes are immobilized in a high density array on a solid surface of a chip. Examples of VLSIPS™ technologies are provided in U.S. Pat. Nos. 5,143,854 and 5,412,087 and in PCT Publications WO 90/15070, WO 92/10092 and WO 95/11995, which describe methods for forming oligonucleotide arrays through techniques such as light-directed synthesis techniques. In designing strategies aimed at providing arrays of nucleotides immobilized on solid supports, further presentation strategies were developed to order and display the oligonucleotide arrays on the chips in an attempt to maximize hybridization patterns and sequence information. Examples of such presentation strategies are disclosed in PCT Publications WO 94/12305, WO 94/11530, WO 97/29212 and WO 97/31256.

Oligonucleotide arrays may comprise at least one of the sequences selected from the group consisting of SEQ ID NOs: 3, 21–38, 57–62, 100–124, 179, 185–338, the preferred hybridization probes for genic PG1-related biallelic markers described above; and the sequences complementary thereto; or a fragment thereof of at least 15 consecutive nucleotides for determining whether a sample contains one or more alleles of the biallelic markers of the present invention. Oligonucleotide arrays may also comprise at least one of the sequences selected from the group consisting of SEQ ID NOs: 179, 339–424; and the sequences complementary thereto or a fragment thereof of at least 15 consecutive nucleotides for amplifying one or more alleles of the PG1-realted biallelic markers. In other embodiments, arrays may also comprise at least one of the sequences selected from the group consisting of SEQ ID 425–578, the preferred microsequencing primers for genic PG1-related biallelic markers described above; and the sequences complementary thereto or a fragment thereof of at least 15 consecutive nucleotides for conducting microsequencing analyses to determine whether a sample contains one or more alleles of PG1-related biallelic marker.

The present invention further encompasses polynucleotide sequences that hybridize to any one of SEQ ID NOs: 3, 69, 100–112, or 179–184 under conditions of high or intermediate stringency as described below:

(i) By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65° C., the preferred hybridization temperature, in prehybridization mixture containing 100 µg/ml denatured salmon sperm DNA and 5–20× 10$^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. Other conditions of high stringency which is used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. Preferably, such sequences encode a homolog of a polypeptide encoded by one of ORF2 to ORF1297. In one embodiment, such sequences encode a mammalian PG1 polypeptide.

(ii) By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of intermediate stringency which is used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. Preferably, such sequences encode a homolog of a polypeptide encoded by one of SEQ ID NOs: 3, 69, 100–112, or 179–184. In one embodiment, such sequences encode a mammalian PG1 polypeptide.

The present invention also encompasses diagnostic kits comprising one or more polynucleotides of the invention with a portion or all of the necessary reagents and instructions for genotyping a test subject by determining the identity of a nucleotide at a PG1-related biallelic marker. The polynucleotides of a kit may optionally be attached to a solid support, or be part of an array or addressable array of polynucleotides. The kit may provide for the determination of the identity of the nucleotide at a marker position by any method known in the art including, but not limited to, a sequencing assay method, a microsequencing assay method, a hybridization assay method, or an allele specific amplification method. Optionally such a kit may include instructions for scoring the results of the determination with respect to the test subjects' risk of contracting a cancer or prostate cancer, or likely response to an anti-cancer agent or anti-prostate cancer agent, or chances of suffering from side effects to an anti-cancer agent or anti-prostate cancer agent.

Preferred Genomic Sequences of the PG-1 Gene

The present invention concerns the genomic sequence of PG-1. The present invention encompasses the PG-1 gene, or PG-1 genomic sequences consisting of, consisting essentially of, or comprising the sequence of SEQ ID No 179, a sequence complementary thereto, as well as fragments and variants thereof. These polynucleotides may be purified, isolated, or recombinant.

The invention also encompasses a purified, isolated, or recombinant polynucleotide comprising a nucleotide sequence having at least 70, 75, 80, 85, 90, or 95% nucleotide identity with a nucleotide sequence of SEQ ID No 179 or a complementary sequence thereto or a fragment thereof. The nucleotide differences as regards to the nucleotide sequence of SEQ ID No 179 may be generally randomly distributed throughout the entire nucleic acid. Nevertheless, preferred nucleic acids are those wherein the nucleotide differences as regards to the nucleotide sequence of SEQ ID No 179 are predominantly located outside the coding sequences contained in the exons. These nucleic acids, as well as their fragments and variants, may be used as oligonucleotide primers or probes in order to detect the presence of a copy of the PG-1 gene in a test sample, or alternatively in order to amplify a target nucleotide sequence within the PG-1 sequences.

Another object of the invention consists of a purified, isolated, or recombinant nucleic acid that hybridizes with the nucleotide sequence of SEQ ID No 179 or a complementary sequence thereto or a variant thereof, under the stringent hybridization conditions as defined above.

Particularly preferred nucleic acids of the invention include isolated, purified, or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No 179 or the complements thereof, wherein said contiguous span comprises at least 1, 2, 3, 5, 10, or 25 of the following nucleotide positions of SEQ ID No 179: 1–2324, 2852–2936, 3204–3249, 3456–3572, 3899–4996, 5028–6086, 6310–8710, 9136–11170, 11534–12104, 12733–13163, 13206–14150, 14191–14302, 14338–14359, 14788–15589, 16050–16409, 16440–21718, 21959–22007, 22086–23057, 23488–23712, 23832–24099, 24165–24376, 24429–24568, 24607–25096, 25127–25269, 25300–27576, 27612–29217, 29415–30776, 30807–30986, 31628–32658, 32699–36324, 36772–39149, 39184–40269, 40580–40683, 40844–41048, 41271–43539, 43570–47024, 47510–48065, 48192–49692, 49723–50174, 52626–53599, 54516–55209, and 55666–56146.

Preferred PG-1 cDNA Sequences

The expression of the PG-1 gene has been shown to lead to the production of at least one mRNA species, the nucleic acid sequence of which is set forth in SEQ ID No 3.

Another object of the invention is a purified, isolated, or recombinant nucleic acid comprising the nucleotide sequence of SEQ ID No 3, complementary sequences thereto, as well as allelic variants, and fragments thereof. Moreover, preferred polynucleotides of the invention include purified, isolated, or recombinant PG-1 cDNAs consisting of, consisting essentially of, or comprising the sequence of SEQ ID No 3. Particularly preferred nucleic acids of the invention include isolated, purified, or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No 3 or the complements thereof, wherein said contiguous span comprises at least 1, 2, 3, 5, 10, or 25 of the following nucleotide positions of SEQ ID No 3: 1–280, 651–690, 3315–4288, and 5176–5227. The invention also pertains to a purified or isolated nucleic acid comprising a polynucleotide having at least 95% nucleotide identity with a polynucleotide of SEQ ID No 3, advantageously 99% nucleotide identity, preferably 99.5% nucleotide identity and most preferably 99.8% nucleotide identity with a polynucleotide of SEQ ID No 3, or a sequence complementary thereto or a biologically active fragment thereof.

Preferred Oligonucleotide Probes And Primers

Polynucleotides derived from the PG-1 gene are useful in order to detect the presence of at least a copy of a nucleotide sequence of SEQ ID No 179, or a fragment, complement, or variant thereof in a test sample.

Particularly preferred probes and primers of the invention include isolated, purified, or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No 179 or the complements thereof, wherein said contiguous span comprises at least 1, 2, 3, 5, 10, or 25 of the following nucleotide positions of SEQ ID No 179: 1–2324, 2852–2936, 3204–3249, 3456–3572, 3899–4996, 5028–6086, 6310–8710, 9136–11170, 11534–12104, 12733–13163, 13206–14150, 14191–14302, 14338–14359, 14788–15589, 16050–16409, 16440–21718, 21959–22007, 22086–23057, 23488–23712, 23832–24099, 24165–24376, 24429–24568, 24607–25096, 25127–25269, 25300–27576, 27612–29217, 29415–30776, 30807–30986, 31628–32658, 32699–36324, 36772–39149, 39184–40269, 40580–40683, 40844–41048, 41271–43539, 43570–47024, 47510–48065, 48192–49692, 49723–50174, 52626–53599, 54516–55209, and 55666–56146.

Another object of the invention is a purified, isolated, or recombinant nucleic acid comprising the nucleotide sequence of SEQ ID No 3, complementary sequences thereto, as well as allelic variants, and fragments thereof. Moreover, preferred probes and primers of the invention include purified, isolated, or recombinant PG-1 cDNAs consisting of, consisting essentially of, or comprising the sequence of SEQ ID No 3. Particularly preferred probes and primers of the invention include isolated, purified, or recombinant polynucleotides comprising a contiguous span of at least 12, 15, 18, 20, 25, 30, 35, 40, 50, 60, 70, 80, 90, 100, 150, 200, 500, or 1000 nucleotides of SEQ ID No 3 or the complements thereof, wherein said contiguous span comprises at least 1, 2, 3, 5, 10, or 25 of the following nucleotide positions of SEQ ID No 3: 1–280, 651–690, 3315–4288, and 5176–5227.

Use of PG1 Nucleic Acids as Reagents

The PG1 genomic DNA of SEQ ID NO: 179, the PG1 cDNA of SEQ ID NO: 3, 112–124 and PG1 alleles responsible for a detectable phenotype (such as those obtainable by the methods of Example 12, and SEQ ID NO:69) can be used to prepare PCR primers for use in diagnostic techniques or genetic engineering methods such as those described above. Example 10 describes the use of the PG1 genomic DNA of SEQ ID NO: 179, the PG1 cDNA of SEQ ID NO: 3, 112–124 and PG1 alleles responsible for a detectable phenotype (such as those obtainable by the methods of Example 12) in PCR amplification procedures.

EXAMPLE 10

The PG1 genomic DNA of SEQ ID NO: 179, the PG1 cDNA of SEQ ID) NO: 3, and PG1 alleles responsible for a detectable phenotype (such as those obtainable by the methods of Example 12) is used to prepare PCR primers for a variety of applications, including isolation procedures for cloning nucleic acids capable of hybridizing to such sequences, diagnostic techniques and forensic techniques. The PCR primers comprise at least 10 consecutive bases of the PG1 genomic DNA of SEQ ID NO: 179, the PG1 cDNA of SEQ ID NO: 3, 112–124 and PG1 alleles responsible for a detectable phenotype (such as those obtainable by the methods of Example 12) or the sequences complementary thereto. Preferably, the PCR primers comprise at least 12, 15, or 17 consecutive bases of these sequences. More preferably, the PCR primers comprise at least 20–30 consecutive bases of the PG1 genomic DNA of SEQ ID NO: 179, the PG1 cDNA of SEQ ID NO: 3, 112–124 and PG1 alleles responsible for a detectable phenotype (such as those obtainable by the methods of Example 12) or the sequences complementary thereto. In some embodiments, the PCR primers may comprise more than 30 consecutive bases of the PG1 genomic DNA of SEQ ID NO: 179, the PG1 cDNA of SEQ ID NO: 3, 112–124 and PG1 alleles responsible for a detectable phenotype (such as those obtainable by the methods of Example 12) or the sequences complementary thereto. It is preferred that the primer pairs to be used together in a PCR amplification have approximately the same G/C ratio, so that melting temperatures are approximately the same.

A variety of PCR techniques are familiar to those skilled in the art. For a review of PCR technology, see Molecular Cloning to Genetic Engineering White, B. A. Ed. in Methods in Molecular Biology 67: Humana Press, Totowa 1997. In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites.

The polynucleotides of the Invention also encompass vectors and DNA constructs as well as other forms of primers and probes. For a thorough description of these embodiments please see Sections VIII, X, and XI below.

III. Polypeptides

PG1 Proteins and Polypeptide Fragments:

The term "PG1 polypeptides" is used herein to embrace all of the proteins and polypeptides of the present invention. Also forming part of the invention are polypeptides encoded by the polynucleotides of the invention, as well as fusion polypeptides comprising such polypeptides. The invention embodies PG1 proteins from human (SEQ ID NOs: 4, and 5), and mouse (SEQ ID NO: 74). However, PG1 species from other varieties of mammals are expressly contemplated and is isolated using the antibodies of the present invention in conjunction with standard affinity chromatography methods as well as being expressed from the PG1 genes isolated from other mammalian sources using human and mouse PG1 nucleic acid sequences as primers and probes as well as the methods described herein.

The invention also embodies PG1 proteins translated from less common alternative splice species, including SEQ ID NOs: 125–136, and PG1 proteins which result from naturally occurring mutant, particularly functional mutants of PG1, including SEQ ID NO: 70, which is identified and obtained by the described herein. The present invention also embodies polypeptides comprising a contiguous stretch of at least 6 amino acids, preferably at least 8 to amino acids, more preferably at least 12, 15, 20, 25, 50, or 100 amino acids of a PG1 protein. In a preferred embodiment the contiguous stretch of amino acids comprises the site of a mutation or functional mutation, including a deletion, addition, swap or truncation of the amino acids in the PG1 protein sequence. For instance, polypeptides that contain either the Arg and His residues at amino acid position 184, and polypeptides that contain either the Arg or Ile residue at amino acid position 293 of the SEQ ID NO: 4 in said contiguous stretch are particularly preferred embodiments of the invention and useful in the manufacture of antibodies to detect the presence and absence of these mutations. Similarly, polypeptides with a carboxy terminus at position 228 is a particularly preferred embodiment of the invention and useful in the manufacture of antibodies to detect the presence and absence of the mutation shown in SEQ ID NOs: 69 and 70.

Similarly, polypeptides that that contain an peptide sequences of 8, 10, 12, 15, or 25 amino acids encoded over a naturally-occurring splice junction (the point at which two human PG1 exon (SEQ ID NOs: 100–111) are covalently linked) in said contiguous stretch are particularly preferred embodiments and useful in the manufacture of antibodies to detect the presence, localization, and quantity of the various protein products of the PG1 alternative splice species.

PG1 proteins are preferably isolated from human, mouse or mammalian tissue samples or expressed from human, mouse or mammalian genes.

The PG1 polypeptides of the invention can be made using routine expression methods known in the art, see, for instance, Example 11, below. The polynucleotide encoding the desired polypeptide, is ligated into an expression vector suitable for any convenient host. Both eukaryotic and prokaryotic host systems is used in forming recombinant polypeptides, and a summary of some of the more common systems are included in Sections II and VIII. The polypeptide is then isolated from lysed cells or from the culture medium and purified to the extent needed for its intended use. Purification is by any technique known in the art, for example, differential extraction, salt fractionation, chromatography, centrifugation, and the like. See, for example, *Methods in Enzymology* for a variety of methods for purifying proteins.

In addition, shorter protein fragments is produced by chemical synthesis. Alternatively the proteins of the invention is extracted from cells or tissues of humans or non-human animals. Methods for purifying proteins are known in the art, and include the use of detergents or chaotropic agents to disrupt particles followed by differential extraction and separation of the polypeptides by ion exchange chromatography, affinity chromatography, sedimentation according to density, and gel electrophoresis.

Preferred PG-1 Proteins and Polypeptide Fragments

The invention embodies PG-1 proteins from humans, including isolated or purified PG-1 proteins consisting, consisting essentially, or comprising the sequence of SEQ ID No 4.

The present invention also embodies isolated, purified, and recombinant polypeptides comprising a contiguous span of at least 6 amino acids, preferably at least 8 to 10 amino acids, more preferably at least 12, 15, 20, 25, 30, 40, 50, or 100 amino acids of SEQ ID No 4, wherein said contiguous span includes at least 1, 2, 3, or 5 of the amino acid positions 1–26, 295–302, and 333–353. In other preferred embodiments the contiguous stretch of amino acids comprises the site of a mutation or functional mutation, including a deletion, addition, swap or truncation of the amino acids in the PG-1 protein sequence.

Expression of the PG1 Protein

Any PG1 cDNA, including SEQ ID NO: 3, 69, 112–124, or 184 or synthetic DNAs is use as described in Example 11 below to express PG1 proteins and polypeptides.

EXAMPLE 11

The nucleic acid encoding the PG1 protein or polypeptide to be expressed is operably linked to a promoter in an expression vector using conventional cloning technology. The PG1 insert in the expression vector may comprise the full coding sequence for the PG1 protein or a portion thereof. For example, the PG1 derived insert may encode a polypeptide comprising at least 10 consecutive amino acids of the PG1 proteins of SEQ ID NO: 4.

The expression vector is any of the mammalian, yeast, insect or bacterial expression systems known in the art, see for example Section VIII. Commercially available vectors and expression systems are available from a variety of suppliers including Genetics Institute (Cambridge, Mass.), Stratagene (La Jolla, Calif.), Promega (Madison, Wis.), and Invitrogen (San Diego, Calif.). If desired, to enhance expression and facilitate proper protein folding, the codon context and codon pairing of the sequence is optimized for the particular expression organism in which the expression vector is introduced, as explained by Hatfield, et al., U.S. Pat. No. 5,082,767.

The following is provided as one exemplary method to express the PG1 protein or a portion thereof. In one embodiment, the entire coding sequence of the PG1 cDNA through the poly A signal of the cDNA are operably linked to a promoter in the expression vector. Alternatively, if the nucleic acid encoding a portion of the PG1 protein lacks a methionine to serve as the initiation site, an initiating methionine can be introduced next to the first codon of the nucleic acid using conventional techniques. Similarly, if the insert from the PG1 cDNA lacks a poly A signal, this sequence can be added to the construct by, for example, splicing out the Poly A signal from pSG5 (Stratagene) using BglI and SalI restriction endonuclease enzymes and incorporating it into the mammalian expression vector pXT1 (Stratagene). pXT1 contains the LTRs and a portion of the gag gene from Moloney Murine Leukemia Virus. The position of the LTRs in the construct allow efficient stable transfection. The vector includes the Herpes Simplex Thymidine Kinase promoter and the selectable neomycin gene. The nucleic acid encoding the PG1 protein or a portion thereof is obtained by PCR from a bacterial vector containing the PG1 cDNA of SEQ ID NO: 3 using oligonucleotide primers complementary to the PG1 cDNA or portion thereof and containing restriction endonuclease sequences for Pst I incorporated into the 5' primer and BglII at the 5' end of the corresponding cDNA 3' primer, taking care to ensure that the sequence encoding the PG1 protein or a portion thereof is positioned properly with respect to the poly A signal. The purified fragment obtained from the resulting PCR reaction is digested with PstI, blunt ended with an exonuclease, digested with Bgl II, purified and ligated to pXT1, now containing a poly A signal and digested with BglII.

The ligated product is transfected into mouse NIH 3T3 cells using Lipofectin (Life Technologies, Inc., Grand Island, N.Y.) under conditions outlined in the product specification. Positive transfectants are selected after growing the transfected cells in 600 ug/ml G418 (Sigma, St. Louis, Mo.).

Alternatively, the nucleic acids encoding the PG1 protein or a portion thereof is cloned into pED6dpc2 (Genetics Institute, Cambridge, Mass.). The resulting pED6dpc2 constructs is transfected into a suitable host cell, such as COS 1 cells. Methotrexate resistant cells are selected and expanded.

The above procedures may also be used to express a mutant PG1 protein responsible for a detectable phenotype or a portion thereof.

The expressed proteins is purified using conventional purification techniques such as ammonium sulfate precipitation or chromatographic separation based on size or charge. The protein encoded by the nucleic acid insert may also be purified using standard immunochromatography techniques. In such procedures, a solution containing the expressed PG1 protein or portion thereof, such as a cell extract, is applied to a column having antibodies against the PG1 protein or portion thereof is attached to the chromatography matrix. The expressed protein is allowed to bind the immunochromatography column. Thereafter, the column is washed to remove non-specifically bound proteins. The specifically bound expressed protein is then released from the column and recovered using standard techniques.

To confirm expression of the PG1 protein or a portion thereof, the proteins expressed from host cells containing an expression vector containing an insert encoding the PG1 protein or a portion thereof can be compared to the proteins expressed in host cells containing the expression vector without an insert. The presence of a band in samples from cells containing the expression vector with an insert which is absent in samples from cells containing the expression vector without an insert indicates that the PG1 protein or a portion thereof is being expressed. Generally, the band will have the mobility expected for the PG1 protein or portion thereof. However, the band may have a mobility different than that expected as a result of modifications such as glycosylation, ubiquitination, or enzymatic cleavage.

Antibodies capable of specifically recognizing the expressed PG1 protein or a portion thereof is generated as described below in Section VII.

If antibody production is not possible, the nucleic acids encoding the PG1 protein or a portion thereof is incorporated into expression vectors designed for use in purification schemes employing chimeric polypeptides. In such strategies the nucleic acid encoding the PG1 protein or a portion thereof is inserted in frame with the gene encoding the other half of the chimera. The other half of the chimera is β-globin or a nickel binding polypeptide encoding sequence. A chromatography matrix having antibody to β-globin or nickel attached thereto is then used to purify the chimeric protein. Protease cleavage sites is engineered between the β-globin gene or the nickel binding polypeptide and the PG1 protein or portion thereof. Thus, the two polypeptides of the chimera is separated from one another by protease digestion.

One useful expression vector for generating β-globin chimerics is pSG5 (Stratagene), which encodes rabbit β-globin. Intron II of the rabbit β-globin gene facilitates splicing of the expressed transcript, and the polyadenylation signal incorporated into the construct increases the level of expression. These techniques are well known to those skilled in the art of molecular biology. Standard methods are published in methods texts such as Davis et al., (Basic Methods in Molecular Biology, L. G. Davis, M. D. Dibner, and J. F. Battey, ed., Elsevier Press, NY, 1986) and many of the methods are available from Stratagene, Life Technologies, Inc., or Promega. Polypeptide may additionally be produced from the construct using in vitro translation systems such as the In vitro Express™ Translation Kit (Stratagene).

IV. Identification of Mutations in the PG1 Gene Which are Associated with a Detectable Phenotype Mutations in the PG1 gene which are responsible for a detectable phenotype is identified by comparing the sequences of the PG1 genes from affected and unaffected individuals as described in Example 12, below. The detectable phenotype may comprise a variety of manifestations of altered PG1 function, including prostate cancer, hepatocellular carcinoma, colorectal cancer, non-small cell lung cancer, squamous cell carcinoma, or other conditions. The mutations may comprise point mutations, deletions, or insertions of the PG1 gene. The mutations may lie within the coding sequence for the PG1 protein or within regulatory regions in the PG1 gene.

EXAMPLE 12

Oligonucleotide primers are designed to amplify the sequences of each of the exons or the promoter region of the PG1 gene. The oligonucleotide primers may comprise at least 10 consecutive nucleotides of the PG1 genomic DNA of SEQ ID NO:179 or the PG1 cDNA of SEQ ID NO: 3 or the sequences complementary thereto. Preferably, the oligonucleotides comprise at least 15 consecutive nucleotides of the PG1 genomic DNA of SEQ ID NO:179 or the PG1 cDNA of SEQ ID NO: 3 or the sequences complementary thereto. In some embodiments, the oligonucleotides may comprise at least 20 consecutive nucleotides of the PG1 genomic DNA of SEQ ID NO: 179 or the PG1 cDNA of SEQ ID NO:3 or the sequences complementary thereto. In other embodiments, the oligonucleotides may comprise 25 or more consecutive nucleotides of the PG1 genomic DNA of SEQ ID NO: 179 or the PG1 cDNA of SEQ ID NO: 3 or the sequences complementary thereto.

Each primer pair is used to amplify the exon or promoter region from which it is derived. Amplification is carried out on genomic DNA samples from affected patients and unaffected controls using the PCR conditions described above. Amplification products from the genomic PCRs are subjected to automated dideoxy terminator sequencing reactions and electrophoresed on ABI 377 sequencers. Following gel image analysis and DNA sequence extraction, ABI sequence data are automatically analyzed to detect the presence of sequence variations among affected and unaffected individuals. Sequences are verified by determining the sequences of both DNA strands for each individual. Preferably, these candidate mutations are detected by comparing individuals homozygous for haplotype 5 of FIG. 4 and controls not carrying haplotype 5 or related haplotypes.

Candidate polymorphisms suspected of being responsible for the detectable phenotype, such as prostate cancer or other conditions, are then verified by screening a larger population of affected and unaffected individuals using the microsequencing technique described above. Polymorphisms which exhibit a statistically significant correlation with the detectable phenotype are deemed responsible for the detectable phenotype.

Other techniques may also be used to detect polymorphisms associated with a detectable phenotype such as prostate cancer or other conditions. For example, polymorphisms is detected using single stranded conformation analyses such as those described in Orita et al., Proc. Natl. Acad. Sci. U.S.A. 86: 2776–2770 (1989). In this approach, polymorphisms are detected through altered migration on SSCA gels.

Alternatively, polymorphisms is identified using clamped denaturing gel electrophoresis, heteroduplex analysis, chemical mismatch cleavage, and other conventional techniques as described in Sheffield, V. C. et al, Proc. Natl. Acad. Sci. U.S.A 49:699–706 (1991); White, M. B. et al., Genomics 12:301–306 (1992); Grompe, M. et al., Proc. Natl. Acad. Sci. U.S.A 86:5855–5892 (1989); and Grompe, M. Nature Genetics 5:111–117 (1993).

The PG1 genes from individuals carrying PG1 mutations responsible for the detectable phenotype, or cDNAs derived therefrom, is cloned as follows. Nucleic acid samples are obtained from individuals having a PG1 mutation associated with the detectable phenotype. The nucleic acid samples are contacted with a probe derived from the PG1 genomic DNA of SEQ ID NO: 179 or the PG1 cDNA of SEQ ID NO:3. Nucleic acids containing the mutant PG1 allele are identified using conventional techniques. For example, the mutant PG1 gene, or a cDNA derived therefrom, is obtained by conducting an amplification reaction using primers derived from the PG1 genomic DNA of SEQ ID NO: 179 or the PG1 cDNA of SEQ ID NO:3. Alternatively, the mutant PG1 gene, or a cDNA derived therefrom, is identified by hybridizing a genomic library or a cDNA library obtained from an individual having a mutant PG1 gene with a detectable probe derived from the PG1 genomic DNA of SEQ ID NO: 179 or the PG1 cDNA of SEQ ID NO: 3. Alternatively, the mutant PG1 allele is obtained by contacting an expression library from an individual carrying a PG1 mutation with a detectable antibody against the PG1 proteins of SEQ ID NO: 4 or SEQ ID NO: 5 which has been prepared as described below. Those skilled in the art will appreciate that the PG1 genomic DNA of SEQ ID NO: 179, the PG1 cDNA of SEQ ID NO: 3 and the PG1 proteins of SEQ ID NOs: 4 and 5 is used in a variety of other conventional techniques to obtain the mutant PG1 gene.

In another embodiment the mutant PG1 allele which causes a detectable phenotype can be isolated by obtaining a nucleic acid sample such as a genomic library or a cDNA library from an individual expressing the detectable phenotype. The nucleic acid sample can be contacted with one or more probes lying in the 8p23 region of the human genome. Nucleic acids in the sample which contain the PG1 gene can be identified by conducting sequencing reactions on the nucleic acids which hybridize to the markers from the 8p23 region of the human genome.

The region of the PG1 gene containing the mutation responsible for the detectable phenotype may also be used in diagnostic techniques such as those described below. For example, oligonucleotides containing the mutation responsible for the detectable phenotype is used in amplification or hybridization based diagnostics, such as those described herein, for detecting individuals suffering from the detectable phenotype or individuals at risk of developing the detectable phenotype at a subsequent time. In addition, the PG1 allele responsible for the detectable phenotype is used in gene therapy as described herein. The PG1 allele responsible for the detectable phenotype may also be cloned into an expression vector to express the mutant PG1 protein a described herein.

During the search for biallelic markers associated with prostate cancer, a number of polymorphic bases were discovered which lie within the PG1 gene. The identities and positions of these polymorphic bases are listed as features in the accompanying Sequence Listing for the PG1 genomic DNA of SEQ ID NO: 179. The polymorphic bases is used in the above-described diagnostic techniques for determining whether an individual is at risk for developing prostate cancer at a subsequent date or suffers from prostate cancer as a result of a PG1 mutation. The identities of the nucleotides present at the polymorphic positions in a nucleic acid sample is determined using the techniques, such as microsequencing analysis, which are described above.

It is possible that one or more of these polymorphisms (or other polymorphic bases) is mutations which are associated with prostate cancer. To determine whether a polymorphism is responsible for prostate cancer, the frequency of each of the alleles in individuals suffering from prostate cancer and unaffected individuals is measured as described in the haplotype analysis above. Those mutations which occur at a statistically significant frequency in the affected population are deemed to be responsible for prostate cancer.

cDNAs containing the identified mutant PG1 gene is prepared as described above and cloned into expression vectors as described below. The proteins expressed from the expression vectors is used to generate antibodies specific for the mutant PG1 proteins as described below. In addition, allele specific probes containing the PG1 mutation responsible for prostate cancer is used in the diagnostic techniques described below.

Genes sharing homology to the PG1 gene is identified as follows.

EXAMPLE 13

Alternatively, a cDNA library or genomic DNA library to be screened for genes sharing homology to the PG1 gene is obtained from a commercial source or made using techniques familiar to those skilled in the art. The cDNA library or genomic DNA library is hybridized to a detectable probe comprising at least 10 consecutive nucleotides from the PG1 cDNA of SEQ ID NO:3, the PG1 genomic DNA of SEQ ID NO: 179, or the sequences complementary thereto, using conventional techniques. Preferably, the probe comprises at least 12, 15, or 17 consecutive nucleotides from the PG1 cDNA of SEQ ID NO:3, the PG1 genomic DNA of SEQ ID NO: 179, or the sequences complementary thereto. More preferably, the probe comprises at least 20–30 consecutive nucleotides from the PG1 cDNA of SEQ ID NO:3, the PG1 genomic DNA of SEQ ID NO: 179, or the sequences complementary thereto. In some embodiments, the probe comprises more than 30 nucleotides from the PG1 cDNA of SEQ ID NO:3, the PG1 genomic DNA of SEQ ID NO: 179, or the sequences complementary thereto.

Techniques for identifying cDNA clones in a cDNA library which hybridize to a given probe sequence are disclosed in Sambrook et al., Molecular Cloning: A Laboratory Manual 2d Ed., Cold Spring Harbor Laboratory Press, 1989. The same techniques is used to isolate genomic DNAs sharing homology with the PG1 gene.

Briefly, cDNA or genomic DNA clones which hybridize to the detectable probe are identified and isolated for further manipulation as follows. A probe comprising at least 10 consecutive nucleotides from the PG1 cDNA of SEQ ID NO:3, the PG1 genomic DNA of SEQ ID NO: 179, or the sequences complementary thereto, is labeled with a detectable label such as a radioisotope or a fluorescent molecule. Preferably, the probe comprises at least 12, 15, or 17 consecutive nucleotides from the PG1 cDNA of SEQ ID NO:3, the PG1 genomic DNA of SEQ ID NO: 179, or the sequences complementary thereto. More preferably, the probe comprises 20–30 consecutive nucleotides from the PG1 cDNA of SEQ ID NO:3, the PG1 genomic DNA of SEQ ID NO: 179, or the sequences complementary thereto. In some embodiments, the probe comprises more than 30 nucleotides from the PG1 cDNA of SEQ ID NO:3, the PG1 genomic DNA of SEQ ID NO: 179, or the sequences complementary thereto.

Techniques for labeling the probe are well known and include phosphorylation with polynucleotide kinase, nick translation, in vitro transcription, and non-radioactive techniques. The cDNAs or genomic DNAs in the library are transferred to a nitrocellulose or nylon filter and denatured. After incubation of the filter with a blocking solution, the filter is contacted with the labeled probe and incubated for a sufficient amount of time for the probe to hybridize to cDNAs or genomic DNAs containing a sequence capable of hybridizing to the probe.

By varying the stringency of the hybridization conditions used to identify cDNAs or genomic DNAs which hybridize to the detectable probe, cDNAs or genomic DNAs having different levels of homology to the probe can be identified and isolated. To identify cDNAs or genomic DNAs having a high degree of homology to the probe sequence, the melting temperature of the probe is calculated using the following formulas:

For probes between 14 and 70 nucleotides in length the melting temperature™ is calculated using the formula: $Tm=81.5+16.6(\log (Na+))+0.41(\text{fraction } G+C)-(600/N)$ where N is the length of the probe.

If the hybridization is carried out in a solution containing formamide, the melting temperature is calculated using the equation $Tm=81.5+16.6(\log (Na+))+0.41(\text{fraction } G+C)-(0.63\% \text{ formamide})-(600/N)$ where N is the length of the probe.

Prehybridization is carried out in 6×SSC, 5× Denhardt's reagent, 0.5% SDS, 100 µg denatured fragmented salmon sperm DNA or 6×SSC, 5× Denhardt's reagent, 0.5% SDS, 100 µg denatured fragmented salmon sperm DNA, 50% formamide. The formulas for SSC and Denhardt's solutions are listed in Sambrook et al., supra.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to cDNAs or genomic DNAs containing sequences complementary thereto or homologous thereto. For probes over 200 nucleotides in length, the hybridization is carried out at 15–25° C. below the Tm. For shorter probes, such as oligonucleotide probes, the hybridization is conducted at 15–25° C. below the Tm. Preferably, for hybridizations in 6×SSC, the hybridization is conducted at approximately 68° C. Preferably, for hybridizations in 50% formamide containing solutions, the hybridization is conducted at approximately 42° C.

All of the foregoing hybridizations would be considered to be under "stringent" conditions.

Following hybridization, the filter is washed in 2×SSC, 0.1% SDS at room temperature for 15 minutes. The filter is then washed with 0.1×SSC, 0.5% SDS at room temperature for 30 minutes to 1 hour. Thereafter, the solution is washed at the hybridization temperature in 0.1×SSC, 0.5% SDS. A final wash is conducted in 0.1×SSC at room temperature.

cDNAs or genomic DNAs homologous to the PG1 gene which have hybridized to the probe are identified by autoradiography or other conventional techniques.

The above procedure is modified to identify cDNAs or genomic DNAs having decreasing levels of homology to the probe sequence. For example, to obtain cDNAs or genomic DNAs of decreasing homology to the detectable probe, less stringent conditions is used. For example, the hybridization temperature is decreased in increments of 5° C. from 68° C. to 42° C. in a hybridization buffer having a Na+ concentration of approximately 1M. Following hybridization, the filter is washed with 2×SSC, 0.5% SDS at the temperature of hybridization. These conditions are considered to be "moderate" conditions above 50° C. and "low" conditions below 50° C.

Alternatively, the hybridization is carried out in buffers, such as 6×SSC, containing formamide at a temperature of 42° C. In this case, the concentration of formamide in the hybridization buffer is reduced in 5% increments from 50% to 0% to identify clones having decreasing levels of homology to the probe. Following hybridization, the filter is washed with 6×SSC, 0.5% SDS at 50° C. These conditions are considered to be "moderate" conditions above 25% formamide and "low" conditions below 25% formamide.

cDNAs or genomic DNAs which have hybridized to the probe are identified by autoradiography.

If it is desired to obtain nucleic acids homologous to the PG1 gene, such as allelic variants thereof or nucleic acids encoding proteins related to the PG1 protein, the level of homology between the hybridized nucleic acid and the PG1 gene may readily be determined. To determine the level of homology between the hybridized nucleic acid and the PG1 gene, the nucleotide sequences of the hybridized nucleic acid and the PG1 gene are compared. For example, using the above methods, nucleic acids having at least 95% nucleic acid homology to the PG1 gene is obtained and identified. Similarly, by using progressively less stringent hybridization conditions one can obtain and identify nucleic acids having at least 90%, at least 85%, at least 80% or at least 75% homology to the PG1 gene.

To determine whether a clone encodes a protein having a given amount of homology to the PG1 protein, the amino acid sequence of the PG1 protein is compared to the amino acid sequence encoded by the hybridizing nucleic acid. Homology is determined to exist when an amino acid sequence in the PG1 protein is closely related to an amino acid sequence in the hybridizing nucleic acid. A sequence is closely related when it is identical to that of the PG1 sequence or when it contains one or more amino acid substitutions therein in which amino acids having similar characteristics have been substituted for one another. Using the above methods, one can obtain nucleic acids encoding proteins having at least 95%, at least 90%, at least 85%, at least 80% or at least 75% homology to the proteins encoded by the PG1 probe.

Isolation and Use of Mutant or Low Frequency PG1 Alleles from Mammalian Prostate Tumor Tissues and Cell lines A single mutant PG1 gene was isolated from a human prostate cancer cell line. The nucleic acid sequence and amino acid sequence of this mutant PG1 are disclosed in SEQ IN NOs: 69 and 70, respectively. This mutant was found to contain a stop codon at codon position number 229, and therefore results in a truncated gene product of only 228 amino acids. The present invention encompasses purified or isolated nucleic acids comprising at least 8, 10, 12, 15, 20, or 25 consecutive nucleotides of SEQ ID NO: 69, preferably containing the mutation in codon number 229. A preferred embodiment of the present invention encompasses purified or isolated nucleic acids comprising at least 8, 10, 12, 15, 20, or 25 consecutive nucleotides of SEQ ID NO: 71.

The present invention is also directed to methods of determining whether an individual is at risk of developing prostate cancer at a later date or whether said individual suffers from prostate cancer as a result of a mutation in the PG1 gene comprising: obtaining a nucleic acid sample from said individual; and determining whether the nucleotides present at one or more of the polymorphic bases in the sequences selected from the group consisting of SEQ ID NOs: 69 and 71 are indicative of a risk of developing prostate cancer at a later date or indicative of prostate cancer resulting from a mutation in the PG1 gene. The present invention also includes purified or isolated nucleic acids encoding at least 4, 8, 10, 12, 15, or 20 consecutive amino acids of the polypeptide of SEQ ID NO: 70, preferably including the carboxy terminus of said polypeptide. The isolated or purified polypeptides of the invention include polypeptides comprising at least 4, 8, 10, 12, 15, or 20 consecutive amino acids of the polypeptide of SEQ ID NO: 70, preferably including the carboxy terminus of said polypeptide.

V. Diagnosis of Individuals at Risk for Developing Prostate Cancer or Individual Suffering From Prostate Cancer as a Result of a Mutation in the PG1 Gene Individuals may then be screened for the presence of polymorphisms in the PG1 gene or protein which are associated with a detectable phenotype such as cancer, prostate cancer or other conditions as described in Example 14, below. The individuals is screened while they are asymptomatic to determine their risk of developing cancer, prostate cancer or other conditions at a subsequent time. Alternatively, individuals suffering from cancer, prostate cancer or other conditions is screened for the presence of polymorphisms in the PG1 gene or protein in order to determine whether therapies which target the PG1 gene or protein should be applied.

EXAMPLE 14

Nucleic acid samples are obtained from a symptomatic or asymptomatic individual. The nucleic acid samples is obtained from blood cells as described above or is obtained from other tissues or organs. For individuals suffering from prostate cancer, the nucleic acid sample is obtained from the tumor. The nucleic acid sample may comprise DNA, RNA, or both. The nucleotides at positions in the PG1 gene where mutations lead to prostate cancer or other detectable phenotypes are determined for the nucleic acid sample.

In one embodiment, a PCR amplification is conducted on the nucleic acid sample as described above to amplify regions in which polymorphisms associated with prostate cancer or other detectable phenotypes have been identified. The amplification products are sequenced to determine whether the individual possesses one or more PG1 polymorphisms associated with prostate cancer or other detectable phenotypes.

Alternatively, the nucleic acid sample is subjected to microsequencing reactions as described above to determine whether the individual possesses one or more PG1 polymorphisms associated with prostate cancer or another detectable phenotype resulting from a mutation in the PG1 gene.

In another embodiment, the nucleic acid sample is contacted with one or more allele specific oligonucleotides which specifically hybridize to one or more PG1 alleles associated with prostate cancer or another detectable phenotype. The nucleic acid sample is also contacted with a second PG1 oligonucleotide capable of producing an amplification product when used with the allele specific oligonucleotide in an amplification reaction. The presence of an amplification product in the amplification reaction indicates that the individual possesses one or more PG1 alleles associated with prostate cancer or another detectable phenotype.

Determination of PG1 Expression Levels

As discussed above, PG1 polymorphisms associated with cancer, prostate cancer or other detectable phenotypes may exert their effects by increasing, decreasing, or eliminating PG1 expression, or in altering the frequency of various transcription species. Accordingly, PG1 expression levels in individuals suffering from cancer, prostate cancer or other detectable phenotypes is compared to those of unaffected individuals to determine whether over-expression, under-expression, loss of expression, or changes in the relative frequency of transcription species of PG1 causes cancer, prostate cancer or another detectable phenotype. Individuals is tested to determine whether they are at risk of developing cancer, or prostate cancer at a subsequent time or whether they suffer from prostate cancer resulting from a mutation in the PG1 gene by determining whether they exhibit a level of PG1 expression associated with prostate cancer. Similarly, individuals is tested to determine whether they suffer from another PG1 mediated detectable phenotype or whether they are at risk of suffering from such a condition at a subsequent time.

Expression levels in nucleic acid samples from affected and unaffected individuals is determined by performing Northern blots using detectable probes derived from the PG1 gene or the PG1 cDNA. A variety of conventional Northern blotting procedures is used to detect and quantitate PG1 expression and the frequencies of the various transcription species of PG1, including those disclosed in Current Protocols in Molecular Biology, John Wiley 503 Sons, Inc. 1997 and Sambrook et al. Molecular Cloning: A Laboratory Manual, Second Edition, Cold Spring Harbor Laboratory Press, 1989.

Alternatively, PG1 expression levels is determined as described in Example 15, below.

EXAMPLE 15

Expression levels and patterns of PG1 is analyzed by solution hybridization with long probes as described in International Patent Application No. WO 97/05277. Briefly, the PG1 cDNA or the PG1 genomic DNA described above, or fragments thereof, is inserted at a cloning site immediately downstream of a bacteriophage (T3, T7 or SP6) RNA polymerase promoter to produce antisense RNA. Preferably, the PG1 insert comprises at least 100 or more consecutive nucleotides of the genomic DNA sequence of SEQ ID NO: 1 or the cDNA sequences of SEQ ID NO: 3. The plasmid is linearized and transcribed in the presence of ribonucleotides comprising modified ribonucleotides (i.e. biotin-UTP and DIG-UTP). An excess of this doubly labeled RNA is hybridized in solution with mRNA isolated from cells or tissues of interest. The hybridizations are performed under standard stringent conditions (40–50° C. for 16 hours in an 80% formamide, 0.4 M NaCl buffer, pH 7–8). The unhybridized probe is removed by digestion with ribonucleases specific for single-stranded RNA (i.e. RNases CL3, T1, Phy M, U2 or A). The presence of the biotin-UTP modification enables capture of the hybrid on a microtitration plate coated with streptavidin. The presence of the DIG modification enables the hybrid to be detected and quantified by ELISA using an anti-DIG antibody coupled to alkaline phosphatase.

Quantitative analysis of PG1 gene expression may also be performed using arrays as described in Sections II and X,. As used here, the term array means an arrangement of a plurality of nucleic acids of sufficient length to permit specific detection of expression of PG1 mRNAs capable of hybridizing thereto. For example, the arrays may contain a plurality of nucleic acids derived from genes whose expression levels are to be assessed. The arrays may include the PG1 genomic DNA of SEQ ID NO:179, the PG1 cDNA of SEQ ID NO:3 or the sequences complementary thereto or fragments thereof. The array may contain some or all of the known alternative splice or transcription species of PG1, including the species in SEQ ID NOs: 3, and 112–124 to determine the relative frequency of particular transcription species. Alternatively, the array may contain polynucleotides which overlap all of the potential splice junctions, including, for example SEQ ID NOs: 137–178, so that the frequency of particular splice junctions can be determined and correlated with traits or used in diagnostics just as expressions levels are. Preferably, the fragments are at least 15 nucleotides in length. In other embodiments, the fragments are at least 25 nucleotides in length. In some embodiments, the fragments are at least 50 nucleotides in length. More preferably, the fragments are at least 100 nucleotides in length. In another preferred embodiment, the fragments are more than 100 nucleotides in length. In some embodiments the fragments is more than 500 nucleotides in length.

For example, quantitative analysis of PG1 gene expression is performed with a complementary DNA microarray as described by Schena et al. (Science 270:467–470, 1995; Proc. Natl. Acad. Sci. U.S.A. 93:10614–10619, 1996). Full length PG1 cDNAs or fragments thereof are amplified by PCR and arrayed from a 96-well microtiter plate onto silylated microscope slides using high-speed robotics. Printed arrays are incubated in a humid chamber to allow rehydration of the array elements and rinsed, once in 0.2% SDS for 1 min, twice in water for 1 min and once for 5 min in sodium borohydride solution. The arrays are submerged in water for 2 min at 95° C., transferred into 0.2% SDS for 1 min, rinsed twice with water, air dried and stored in the dark at 25° C.

Cell or tissue mRNA is isolated or commercially obtained and probes are prepared by a single round of reverse transcription. Probes are hybridized to 1 cm$^2$ microarrays under a 14×14 mm glass coverslip for 6–12 hours at 60° C. Arrays are washed for 5 min at 25° C. in low stringency wash buffer (1×SSC/0.2% SDS), then for 10 min at room temperature in high stringency wash buffer (0.1×SSC/0.2% SDS). Arrays are scanned in 0.1×SSC using a fluorescence laser scanning device fitted with a custom filter set. Accurate differential expression measurements are obtained by taking the average of the ratios of two independent hybridizations.

Quantitative analysis of PG1 gene expression may also be performed with full length PG1 cDNAs or fragments thereof in complementary DNA arrays as described by Pietu et al. (Genome Research 6:492–503, 1996). The full length PG1 cDNA or fragments thereof is PCR amplified and spotted on membranes. Then, mRNAs originating from various tissues or cells are labeled with radioactive nucleotides. After hybridization and washing in controlled conditions, the hybridized mRNAs are detected by phospho-imaging or autoradiography. Duplicate experiments are performed and a quantitative analysis of differentially expressed mRNAs is then performed.

Alternatively, expression analysis using the PG1 genomic DNA, the PG1 cDNA, or fragments thereof can be done through high density nucleotide arrays as described by Lockhart et al. (Nature Biotechnology 14: 1675–1680, 1996) and Sosnowsky et al. (Proc. Natl. Acad. Sci. 94:1119–1123, 1997). Oligonucleotides of 15–50 nucleotides from the sequences of the PG1 genomic DNA of SEQ ID NO: 179, the PG1 cDNA of SEQ ID NO: 3, 112–124 or the sequences complementary thereto, are synthesized directly on the chip (Lockhart et al., supra) or synthesized and then addressed to the chip (Sosnowski et al., supra).

PG1 cDNA probes labeled with an appropriate compound, such as biotin, digoxigenin or fluorescent dye, are synthesized from the appropriate mRNA population and then randomly fragmented to an average size of 50 to 100 nucleotides. The said probes are then hybridized to the chip. After washing as described in Lockhart et al., supra and application of different electric fields (Sosnowsky et al., Proc. Natl. Acad. Sci. 94:1119–1123)., the dyes or labeling compounds are detected and quantified. Duplicate hybridizations are performed. Comparative analysis of the intensity of the signal originating from cDNA probes on the same target oligonucleotide in different cDNA samples indicates a differential expression of PG1 mRNA.

The above methods may also be used to determine whether an individual exhibits a PG1 expression pattern associated with cancer, prostate cancer or other diseases. In such methods, nucleic acid samples from the individual are assayed for PG1 expression as described above. If a PG1 expression pattern associated with cancer, prostate cancer, or another disease is observed, an appropriate diagnosis is rendered and appropriate therapeutic techniques which target the PG1 gene or protein is applied.

The above methods may also be applied using allele specific probes to determine whether an individual possesses a PG1 allele associated with cancer, prostate cancer, or another disease. In such approaches, one or more allele specific oligonucleotides containing polymorphic nucleotides in the PG1 gene which are associated with prostate cancer are fixed to a microarray. The array is contacted with a nucleic acid sample from the individual being tested under conditions which permit allele specific hybridization of the sample nucleic acid to the allele specific PG1 probes. Hybridization of the sample nucleic acid to one or more of the allele specific PG1 probes indicates that the individual suffers from prostate cancer caused by the PG1 gene or that the individual is at risk for developing prostate cancer at a subsequent time. Alternatively, any of the genotyping methods described in Section X is utilized.

Use of the Biallelic Markers of the Invention in Diagnostics

The biallelic markers of the present invention can also be used to develop diagnostics tests capable of identifying individuals who express a detectable trait as the result of a specific genotype or individuals whose genotype places them at risk of developing a detectable trait at a subsequent time.

The diagnostic techniques of the present invention may employ a variety of methodologies to determine whether a test subject has a biallelic marker pattern associated with an increased risk of developing a detectable trait or whether the individual suffers from a detectable trait as a result of a particular mutation, including methods which enable the analysis of individual chromosomes for haplotyping, such as family studies, single sperm DNA analysis or somatic hybrids. The trait analyzed using the present diagnostics is any detectable trait, cancer, prostate cancer or another disease, a response to an anti-cancer, or anti-prostate cancer, or side effects to an anti-cancer or anti-prostate cancer agent. Diagnostics, which analyze and predict response to a drug or side effects to a drug, is used to determine whether an individual should be treated with a particular drug. For example, if the diagnostic indicates a likelihood that an individual will respond positively to treatment with a particular drug, the drug is administered to the individual. Conversely, if the diagnostic indicates that an individual is likely to respond negatively to treatment with a particular drug, an alternative course of treatment is prescribed. A negative response is defined as either the absence of an efficacious response or the presence of toxic side effects.

Clinical drug trials represent another application for the markers of the present invention. One or more markers indicative of response to an anti-cancer or anti-prostate cancer agent or to side effects to an anti-cancer or anti-prostate cancer agent is identified using the methods described in Section XI, below. Thereafter, potential participants in clinical trials of such an agent is screened to identify those individuals most likely to respond favorably to the drug and exclude those likely to experience side effects. In that way, the effectiveness of drug treatment is measured in individuals who respond positively to the drug, without lowering the measurement as a result of the inclusion of individuals who are unlikely to respond positively in the study and without risking undesirable safety problems. Preferably, in such diagnostic methods, a nucleic acid sample is obtained from the individual and this sample is genotyped using methods described in Section X.

Another aspect of the present invention relates to a method of determining whether an individual is at risk of developing a trait or whether an individual expresses a trait as a consequence of possessing a particular trait-causing allele. The present invention relates to a method of determining whether an individual is at risk of developing a plurality of traits or whether an individual expresses a plurality of traits as a result of possessing a particular trait-causing allele. These methods involve obtaining a nucleic acid sample from the individual and determining whether the nucleic acid sample contains one or more alleles of one or more biallelic markers indicative of a risk of developing the trait or indicative that the individual expresses the trait as a result of possessing a particular trait-causing allele.

As described herein, the diagnostics is based on a single biallelic marker or a group of biallelic markers.

VI. Assaying the PG1 Protein for Involvement in Receptor/Ligand Interactions

The expressed PG1 protein or portion thereof is evaluated for involvement in receptor/ligand interactions as described in Example 16 below.

EXAMPLE 16

The proteins encoded by the PG1 gene or a portion thereof may also be evaluated for their involvement in receptor/ligand interactions. Numerous assays for such involvement are familiar to those skilled in the art, including the assays disclosed in the following references: Chapter 7.28 (Measurement of Cellular Adhesion under Static Conditions 7.28.1–7.28.22) in Current Protocols in Immunology, J. E. Coligan et al. Eds. Greene Publishing Associates and Wiley-Interscience; Takai et al., Proc. Natl. Acad. Sci. USA 84:6864–6868, 1987; Bierer et al., J. Exp. Med. 168:1145–1156, 1988; Rosenstein et al., J. Exp. Med. 169:149–160, 1989; Stoltenborg et al., J. Immunol. Methods 175:59–68, 1994; Stitt et al., Cell 80:661–670, 1995; Gyuris et al., Cell 75:791–803, 1993.

For example, the proteins of the present invention may demonstrate activity as receptors, receptor ligands or inhibitors or agonists of receptor/ligand interactions. Examples of such receptors and ligands include, without limitation, cytokine receptors and their ligands, receptor kinases and their ligands, receptor phosphatases and their ligands, receptors involved in cell-cell interactions and their ligands (including without limitation, cellular adhesion molecules (such as sclectins, integrins and their ligands) and receptor/ligand pairs involved in antigen presentation, antigen recognition and development of cellular and humoral immune responses). Receptors and ligands are also useful for screening of potential peptide or small molecule inhibitors of the relevant receptor/ligand interaction. A protein of the present invention (including, without limitation, fragments of receptors and ligands) may themselves be useful as inhibitors of receptor/ligand interactions.

The PG1 protein or portions thereof described above is used in drug screening procedures to identify molecules which are agonists, antagonists, or inhibitors of PG1 activity. The PG1 protein or portion thereof used in such analyses is free in solution or linked to a solid support. Alternatively, PG1 protein or portions thereof can be expressed on a cell surface. The cell may naturally express the PG1 protein or portion thereof or, alternatively, the cell may express the PG1 protein or portion thereof from an expression vector such as those described below.

In one method of drug screening, eukaryotic or prokaryotic host cells which are stably transformed with recombinant polynucleotides in order to express the PG1 protein or a portion thereof are used in conventional competitive binding assays or standard direct binding assays. For example, the formation of a complex between the PG1 protein or a portion thereof and the agent being tested is measured in direct binding assays. Alternatively, the ability of a test agent to prevent formation of a complex between the PG1 protein or a portion thereof and a known ligand is measured.

Alternatively, the high throughput screening techniques disclosed in the published PCT application WO 84/03564, is used. In such techniques, large numbers of small peptides to be tested for PG1 binding activity are synthesized on a surface and affixed thereto. The test peptides are contacted with the PG1 protein or a portion thereof, followed by a wash step. The amount of PG1 protein or portion thereof which binds to the test compound is quantitated using conventional techniques.

In some methods, PG1 protein or a portion thereof is fixed to a surface and contacted with a test compound. After a washing step, the amount of test compound which binds to the PG1 protein or portion thereof is measured.

In another approach, the three dimensional structure of the PG1 protein or a portion thereof may be determined and used for rational drug design.

Alternatively, the PG1 protein or a portion thereof is expressed in a host cell using expression vectors such as those described herein. The PG1 protein or portion thereof is an isotype which is associated with prostate cancer or an isotype which is not associated with prostate cancer. The cells expressing the PG1 protein or portion thereof are contacted with a series of test agents and the effects of the test agents on PG1 activity are measured. Test agents which modify PG1 activity is employed in therapeutic treatments.

The above procedures may also be applied to evaluate mutant PG1 proteins responsible for a detectable phenotype.

Identification of Proteins which Interact with the PG1 Protein

Proteins which interact with the PG1 protein is identified as described in Example 17, below.

EXAMPLE 17

Proteins which interact with the PG1 protein or a portion thereof, is identified using two hybrid systems such as the Matchmaker Two Hybrid System 2 (Catalog No. K1604-1, Clontech). As described in the manual accompanying the Matchmaker Two Hybrid System 2 (Catalog No. K1604-1, Clontech), nucleic acids encoding the PG1 protein or a portion thereof, are inserted into an expression vector such that they are in frame with DNA encoding the DNA binding domain of the yeast transcriptional activator GAL4. cDNAs in a cDNA library which encode proteins which might interact with the polypeptides encoded by the nucleic acids encoding the PG1 protein or a portion thereof are inserted into a second expression vector such that they are in frame with DNA encoding the activation domain of GAL4. The two expression plasmids are transformed into yeast and the yeast are plated on selection medium which selects for expression of selectable markers on each of the expression vectors as well as GAL4 dependent expression of the HIS3 gene. Transformants capable of growing on medium lacking histidine are screened for GAL4 dependent lacZ expression. Those cells which are positive in both the histidine selection and the lacZ assay contain plasmids encoding proteins which interact with the polypeptide encoded by the nucleic acid inserts.

Alternatively, the system described in Lustig et al., Methods in Enzymology 283: 83–99 (1997), is used for identifying molecules which interact with the PG1 protein or a portion thereof. In such systems, in vitro transcription reactions are performed on vectors containing an insert encoded the PG1 protein or a portion thereof cloned downstream of a promoter which drives in vitro transcription. The resulting mRNA is introduced into *Xenopus laevis* oocytes. The oocytes are then assayed for a desired activity.

Alternatively, the in vitro transcription products produced as described above is translated in vitro. The in vitro translation products can be assayed for a desired activity or for interaction with a known polypeptide.

The system described in U.S. Pat. No. 5,654,150 may also be used to identify molecules which interact with the PG1 protein or a portion thereof. In this system, pools of cDNAs are transcribed and translated in vitro and the reaction products are assayed for interaction with a known polypeptide or antibody.

Proteins or other molecules interacting with the PG1 protein or portions thereof can be found by a variety of additional techniques. In one method, affinity columns containing the PG1 protein or a portion thereof can be constructed. In some versions of this method the affinity column contains chimeric proteins in which the PG1 protein or a portion thereof is fused to glutathione S-transferase. A mixture of cellular proteins or pool of expressed proteins as described above is applied to the affinity column. Proteins interacting with the polypeptide attached to the column can then be isolated and analyzed on 2-D electrophoresis gel as described in Ramunsen et al. Electrophoresis, 18, 588–598 (1997). Alternatively, the proteins retained on the affinity column can be purified by electrophoresis based methods and sequenced. The same method can be used to isolate antibodies, to screen phage display products, or to screen phage display human antibodies.

Proteins interacting with the PG1 protein or portions thereof can also be screened by using an Optical Biosensor as described in Edwards et Leatherbarrow, Analytical Biochemistry, 246, 1–6 (1997). The main advantage of the method is that it allows the determination of the association rate between the protein and other interacting molecules. Thus, it is possible to specifically select interacting molecules with a high or low association rate. Typically a target molecule is linked to the sensor surface (through a carboxymethyl dextran matrix) and a sample of test molecules is placed in contact with the target molecules. The binding of a test molecule to the target molecule causes a change in the refractive index and/ or thickness. This change is detected by the Biosensor provided it occurs in the evanescent field (which extend a few hundred nanometers from the sensor surface). In these screening assays, the target molecule can be the PG1 protein or a portion thereof and the test sample can be a collection of proteins extracted from tissues or cells, a pool of expressed proteins, combinatorial peptide and/ or chemical libraries, or phage displayed peptides. The tissues or cells from which the test proteins are extracted can originate from any species.

In other methods, a target protein is immobilized and the test population is the PG1 protein or a portion thereof.

To study the interaction of the PG1 protein or a portion thereof with drugs, the microdialysis coupled to HPLC method described by Wang et al., Chromatographia, 44, 205–208(1997) or the affinity capillary electrophoresis method described by Busch et al., J. Chromatogr. 777: 311–328 (1997).

The above procedures may also be applied to evaluate mutant PG1 proteins responsible for a detectable phenotype.

VII. Production of Antibodies Against PG1 Polypeptides

Any PG1 polypeptide or whole protein (SEQ ID NOs: 4, 5, 70, 74, 125–136) whether human, mouse or mammalian is used to generate antibodies capable of specifically binding to expressed PG1 protein or fragments thereof as described in Example 16, below. The antibodies is capable of binding the full length PG1 protein. PG1 proteins which result from naturally occurring mutant, particularly functional mutants of PG1, including SEQ ID NO: 70, which may used in the production of antibodies. The present invention also contemplates the use of polypeptides comprising a contiguous stretch of at least 6 amino acids, preferably at least 8 to 10 amino acids, more preferably at least 12, 15, 20, 25, 50, or 100 amino acids of any PG1 protein in the manufacture of antibodies. In a preferred embodiment the contiguous stretch of amino acids comprises the site of a mutation or functional mutation, including a deletion, addition, swap or truncation of the amino acids in the PG1 protein sequence. For instance, polypeptides that contain either the Arg and His residues at amino acid position 184, and polypeptides that contain either the Arg or Ile residue at amino acid position 293 of the SEQ ID NO: 4 in said contiguous stretch are particularly preferred embodiments of the invention and useful in the manufacture of antibodies to detect the presence and absence of these mutations. Similarly, polypeptides with a carboxy terminus at position 228 is a particularly preferred embodiment of the invention and useful in the manufacture of antibodies to detect the presence and absence of the mutation shown in SEQ ID NOs: 69 and 70. Similarly, polypeptides that that contain an peptide sequences of 8, 10, 12, 15, or 25 amino acids encoded over a naturally-occurring splice junction (the point at which two human PG1 exon (SEQ ID NOs: 100–111) are covalently linked) in said contiguous stretch are particularly preferred embodiments and useful in the manufacture of antibodies to detect the presence, localization, and quantity of the various protein products of the PG1 alternative splice species.

Alternatively, the antibodies is screened so as to isolate those which are capable of binding an epitope-containing fragment of at least 8, 10, 12, 15, 20, 25, or 30 amino acids of a human, mouse, or mammalian PG1 protein, preferably a sequence selected from SEQ ID NOs: 4, 5, 70, 74, or 125–136.

Antibodies may also be generated which are capable of specifically binding to a given isoform of the PG1 protein. For example, the antibodies is capable of specifically binding to an isoform of the PG1 protein which causes prostate cancer or another detectable phenotype which has been obtained as described above and expressed from an expression vector as described above. Alternatively, the antibodies is capable of binding to an isoform of the PG1 protein which does not cause prostate cancer. Such antibodies is used in diagnostic assays in which protein samples from an individual are evaluated for the presence of an isoform of the PG1 protein which causes cancer or another detectable phenotype using techniques such as Western blotting or ELISA assays.

Non-human animals or mammals, whether wild-type or transgenic, which express a different species of PG1 than the one to which antibody binding is desired, and animals which do not express PG1 (i.e. an PG1 knock out animal as described in Section VIII.) are particularly useful for preparing antibodies. PG1 knock out animals will recognize all or most of the exposed regions of PG1 as foreign antigens, and therefore produce antibodies with a wider array of PG1 epitopes. The humoral immune system of animals which produce a species of PG1 that resembles the antigenic sequence will preferentially recognize the differences between the animal's native PG1 species and the antigen sequence, and produce antibodies to these unique sites in the antigen sequence.

Preferred Antibodies That Bind PG-1 Polypeptides of the Invention

Any PG-1 polypeptide or whole protein may be used to generate antibodies capable of specifically binding to an expressed PG-1 protein or fragments thereof as described.

One antibody composition of the invention is capable of specifically binding or specifically bind to the variant of the PG-1 protein of SEQ ID No 4. For an antibody composition to specifically bind to a first variant of PG-1, it must demonstrate at least a 5%, 10%, 15%, 20%, 25%, 50%, or 100% greater binding affinity for a full length first variant of the PG-1 protein than for a full length second variant of the PG-1 protein in an ELISA, RIA, or other antibody-based binding assay.

In a preferred embodiment, the invention concerns antibody compositions, either polyclonal or monoclonal, capable of selectively binding, or selectively bind to an epitope-containing polypeptide comprising a contiguous span of at least 6 amino acids, preferably at least 8 to 10 amino acids, more preferably at least 12, 15, 20, 25, 30, 40, 50, or 100 amino acids of SEQ ID No 4, wherein said epitope comprises at least 1, 2, 3, or 5 of the amino acid positions 1–26, 295–302, and 333–353.

The invention also concerns a purified or isolated antibody capable of specifically binding to a mutated PG-1 protein or to a fragment or variant thereof comprising an epitope of the mutated PG-1 protein. In another preferred embodiment, the present invention concerns an antibody capable of binding to a polypeptide comprising at least 10 consecutive amino acids of a PG-1 protein and including at least one of the amino acids which can be encoded by the trait causing mutations.

In a preferred embodiment, the invention concerns the use in the manufacture of antibodies of a polypeptide comprising a contiguous span of at least 6 amino acids, preferably at least 8 to 10 amino acids, more preferably at least 12, 15, 20, 25, 30, 40, 50, or 100 amino acids of SEQ ID No 4, wherein said contiguous span comprises at least 1, 2, 3, or 5 of the amino acid positions 1–26, 295–302, and 333–353.

EXAMPLE 18

Substantially pure protein or polypeptide is isolated from transfected or transformed cells containing an expression vector encoding the PG1 protein or a portion thereof as described in Example 11. The concentration of protein in the final preparation is adjusted, for example, by concentration on an Amicon filter device, to the level of a few micrograms/ml. Monoclonal or polyclonal antibody to the protein can then be prepared as follows:

A. Monoclonal Antibody Production by Hybridoma Fusion

Monoclonal antibody to epitopes in the PG1 protein or a portion thereof can be prepared from murine hybridomas according to the classical method of Kohler, G. and Milstein, C., Nature 256:495 (1975) or derivative methods thereof. Also see Harlow, E., and D. Lane. 1988. Antibodies A Laboratory Manual. Cold Spring Harbor Laboratory. pp. 53–242.

Briefly, a mouse is repetitively inoculated with a few micrograms of the PG1 protein or a portion thereof over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as originally described by Engvall, E., Meth. Enzymol. 70:419 (1980), and derivative methods thereof. Selected positive clones can be expanded and their monoclonal antibody product harvested for use. Detailed procedures for monoclonal antibody production are described in Davis, L. et al. Basic Methods in Molecular Biology Elsevier, New York. Section 21-2.

B. Polyclonal Antibody Production by Immunization

Polyclonal antiserum containing antibodies to heterogeneous epitopes in the PG1 protein or a portion thereof can be prepared by immunizing suitable non-human animal with the PG1 protein or a portion thereof, which can be unmodified or modified to enhance immunogenicity. A suitable non-human animal is preferably a non-human mammal is selected, usually a mouse, rat, rabbit, goat, or horse. Alternatively, a crude preparation which has been enriched for PG1 concentration can be used to generate antibodies. Such proteins, fragments or preparations are introduced into the non-human mammal in the presence of an appropriate adjuvant (e.g. aluminum hydroxide, RIBI, etc.) which is known in the art. In addition the protein, fragment or preparation can be pretreated with an agent which will increase antigenicity, such agents are known in the art and include, for example, methylated bovine serum albumin (mBSA), bovine serum albumin (BSA), Hepatitis B surface antigen, and keyhole limpet hemocyanin (KLH). Serum from the immunized animal is collected, treated and tested according to known procedures. If the serum contains polyclonal antibodies to undesired epitopes, the polyclonal antibodies can be purified by immunoaffinity chromatography.

Effective polyclonal antibody production is affected by many factors related both to the antigen and the host species. Also, host animals vary in response to site of inoculations and dose, with both inadequate or excessive doses of antigen resulting in low titer antisera. Small doses (ng level) of antigen administered at multiple intradermal sites appears to be most reliable. Techniques for producing and processing polyclonal antisera are known in the art, see for example, Mayer and Walker (1987). An effective immunization protocol for rabbits can be found in Vaitukaitis, J. et al. J. Clin. Endocrinol. Metab. 33:988–991 (1971).

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony, O. et al., Chap. 19 in: Handbook of Experimental Immunology D. Wier (ed) Blackwell (1973). Plateau concentration of antibody is usually in the range of 0.1 to 0.2 mg/ml of serum (about 12 µM). Affinity of the antisera for the antigen is determined by preparing competitive binding curves, as described, for example, by Fisher, D., Chap. 42 in: Manual of Clinical Immunology, 2d Ed. (Rose and Friedman, Eds.) Amer. Soc. For Microbiol., Washington, D.C. (1980).

Antibody preparations prepared according to either the monoclonal or the polyclonal protocol are useful in quantitative immunoassays which determine concentrations of antigen-bearing substances in biological samples; they are also used semi-quantitatively or qualitatively to identify the presence of antigen in a biological sample. The antibodies may also be used in therapeutic compositions for killing cells expressing the protein or reducing the levels of the protein in the body.

VIII. Vectors and the Uses of Polynucleotides in Cells, Animals, and Humans

The nucleic acids of the invention include expression vectors, amplification vectors, PCR-suitable polynucleotide primers, and vectors which are suitable for the introduction of a polynucleotide of the invention into an embryonic stem cells for the production of transgenic non-human animals. In addition, vectors which are suitable for the introduction of a polynucleotide of the invention into cells, organs and individuals, including human individuals, for the purposes of gene therapy to reduce the severity of or prevent genetic diseases associated with functional mutations in PG1 genes are encompassed by the present invention. Functional mutations in PG1 genes which are suitable as targets for the gene therapy and transgenic vectors and methods of the invention include, but are not limited to, mutations in the coding region of the PG1 gene which affect the amino acid sequence of the PG1 gene's product, mutations in the promoter or other regulatory regions which affect the levels of PG1 expression, mutations in the PG1 splice sites which affect length of the PG1 gene product or the relative frequency of PG1 alternative splicing species, and any other mutation which in any way affects the level or quality of PG1 expression or activity. The gene therapy methods can be achieved by targeting vectors and method for changing a mutant PG1 gene into a wild-type PG1 gene in a embryonic stem cell or somatic cell. Alternatively, the present invention also encompasses methods and vectors for introducing the expression of wild-type PG1 sequences without the disruption of any mutant PG1 which already reside in the cell, organ or individual.

The invention also embodies amplification vectors, which comprise a polynucleotide of the invention, and an origin of replication. Preferably, such amplification vectors further comprise restriction endonuclease sites flanking the polynucleotide, so as to facilitate cleavage and purification of the polynucleotides from the remainder of the amplification vector, and a selectable marker, so as to facilitate amplification of the amplification vector. Most preferably, the restriction endonuclease sites in the amplification vector are situated such that cleavage at those site would result in no other amplification vector fragments of a similar size.

Thus, such an amplification vector is transfected into a host cell compatible with the origin of replication of said amplification vector, wherein the host cell is a prokaryotic or eukaryotic cell, preferably a mammalian, insect, yeast, or bacterial cell, most preferably an *Escherichia coli* cell. The resulting transfected host cells is grown by culture methods known in the art, preferably under selection compatible with the selectable marker (e.g., antibiotics). The amplification vectors can be isolated and purified by methods known in the art (e.g., standard plasmid prep procedures). The polynucleotide of the invention can be cleaved with restriction enzymes that specifically cleave at the restriction endonuclease sites flanking the polynucleotide, and the double-stranded polynucleotide fragment purified by techniques known in the art, including gel electrophoresis.

Alternatively linear polynucleotides comprising a polynucleotide of the invention is amplified by PCR. The PCR method is well known in the art and described in, e.g., U.S. Pat. Nos. 4,683,195 and 4,683,202 and Saiki, R et al. 1988. Science 239:487–491, and European patent applications 86302298.4, 86302299.2 and 87300203.4, as well as Methods in Enzymology 1987 155:335–350.

The polynucleotides of the invention can also be derivatized in various ways, including those appropriate for facilitating transfection and/or gene therapy. The polynucleotides can be derivatized by attaching a nuclear localization signal to it to improve targeted delivery to the nucleus. One well-characterized nuclear localization signal is the heptapeptide PKKKRKV (pro-lys-lys-lys-arg-lys-val). Preferably, in the case of polynucleotides in the form of a closed circle, the nuclear localization signal is attached via a modified loop nucleotide or spacer that forms a branching structure.

If it is to be used in vivo, the polynucleotide of the invention is derivatized to include ligands and/or delivery vehicles which provide dispersion through the blood, targeting to specific cell types, or permit easier transit of cellular barriers. Thus, the polynucleotides of the invention is linked or combined with any targeting or delivery agent known in the art, including but not limited to, cell penetration enhancers, lipofectin, liposomes, dendrimers, DNA intercalators, and nanoparticles. In particular, nanoparticles for use in the delivery of the polynucleotides of the invention are particles of less than about 50 nanometers diameter, nontoxic, non-antigenic, and comprised of albumin and surfactant, or iron as in the nanoparticle particle technology of SynGenix. In general the delivery vehicles used to target the polynucleotides of the invention may further comprise any cell specific or general targeting agents known in the art, and will have a specific trapping efficiency to the target cells or organs of from about 5 to about 35%.

The polynucleotides of the invention is used ex vivo in a gene therapy method for obtaining cells or organs which produce wild-type PG1 or PG1 proteins which have been selectively mutated. The cells are created by incubation of the target cell with one or more of the above-described polynucleotides under standard conditions for uptake of nucleic acids, including electroporation or lipofection. In practicing an ex vivo method of treating cells or organs, the concentration of polynucleotides of the invention in a solution prepare to treat target cells or organs is from about 0.1 to about 100 µM, preferably 0.5 to 50 µM, most preferably from 1 to 10 µM.

Alternatively, the oligonucleotides can be modified or co-administered for targeted delivery to the nucleus. Improved oligonucleotide stability is expected in the nucleus due to: (1) lower levels of DNases and RNases; and (2) higher oligonucleotide concentrations due to lower total volume.

Alternatively, the polynucleotides of the invention can be covalently bonded to biotin to form a biotin-polynucleotide prodrug by methods known in the art, and co-administered with a receptor ligand bound to avidin or receptor specific antibody bound to avidin, wherein the receptor is capable of causing uptake of the resulting polynucleotide-biotin-avidin complex into the cells. Receptors that cause uptake are known to those of skill in the art.

The invention encompasses vectors which are suitable for the introduction of a polynucleotide of the invention into an embryonic stem cell for the production of transgenic non-human animals, which in turn result in the expression of recombinant PG1 in the transgenic animal. Any appropriate vector system can be used for the introduction and expression of PG1 in transgenic animals, including for example yeast artificial chromosomes (YAC), bacterial artificial chromosomes (BAC), bacteriophage P1, and other vectors known in the art which are able to accommodate sufficiently large inserts to encode the PG1 protein or desired fragments thereof. Selected alterations, additions and deletions in the PG1 gene may optionally be achieved by site-directed mutagenesis. Once an appropriate vector system is chosen, the site-directed mutagenesis process may then be conducted by techniques well known in the art, and the fragment be returned and ligated to the larger vector from which it was cleaved. For site directed mutagenesis methods see, for example, Kunkel, T. 1985. Proc. Natl. Acad. Sci. U.S.A. 82:488; Bandeyar, M. et al. 1988. Gene 65: 129–133; Nelson, M., and M. McClelland 1992. Methods Enzymol. 216:279–303; Weiner, M. 1994. Gene 151: 119–123; Costa, G. and M. Weiner. 1994. Nucleic Acids Res. 22: 2423; Hu, G. 1993. DNA and Cell Biology 12:763–770; and Deng, W. and J. Nickoff. 1992. Anal. Biochem. 200:81.

Briefly, the transgenic technology used herein involves the inactivation, addition or replacement of a portion of the PG1 gene or the entire gene. For example the present technology includes the addition of PG1 genes with or without the inactivation of the non-human animal's native PG1 genes, as described in the preceding two paragraphs and in the Examples. The invention also encompasses the use of vectors, and the vectors themselves which target and modify an existing human PG1 gene in a stem cell, whether it is contained in a non-human animal cell where it was previously introduced into the germ line by transgenic technology or it is a native PG1 gene in a human pluripotent or somatic cell. This transgene technology usually relies on homologous recombination in a pluripotent cell that is capable of differentiating into germ cell tissue. A DNA construct that encodes an altered region of the non-human animal's PG1 gene that contains, for instance a stop codon to destroy expression, is introduced into the nuclei of embryonic stem cells. Preferably mice are used for this transgenic work. In a portion of the cells, the introduced DNA recombines with the endogenous copy of the cell's gene, replacing it with the altered copy. Cells containing the newly engineered genetic alteration are injected in a host embryo of the same species as the stem cell, and the embryo is reimplanted into a recipient female. Some of these embryos develop into chimeric individuals that posses germ cells entirely derived from the mutant cell line. Therefore, by breeding the chimeric progeny it is possible to obtain a new strain containing the introduced genetic alteration. See Capecchi 1989. Science. 244:1288–1292 for a review of this procedure.

The present invention encompasses the polynucleotides described herein, as well as the methods for making these polynucleotides including the method for creating a mutation in a human PG1 gene. In addition, the present invention encompasses cells which comprise the polynucleotides of the invention, including but not limited to amplification host cells comprising amplification vectors of the invention. Furthermore the present invention comprises the embryonic stem cells and transgenic non-human animals and mammals described herein which comprise a gene encoding a human PG1 protein.

DNA Construct That Enables Directing Temporal and Spatial Gene Expression in Recombinant Host Cells and in Transgenic Animals.

In order to study the physiological and phenotype consequences of a lack of synthesis of the PG1 protein, both at the cellular level and at the multi-cellular organism level, in particular as regards to disorders related to abnormal cell proliferation, notably cancers, the invention also encompasses DNA constructs and recombinant vectors enabling a conditional expression of a specific allele of the PG1 genomic sequence or cDNA and also of a copy of this genomic sequence or cDNA harboring substitutions, deletions, or additions of one or more bases as regards to the PG1 nucleotide sequence of SEQ ID NOs: 3, 112–125, 179, 182–184, or a fragment thereof, these base substitutions, deletions or additions being located either in an exon, an intron or a regulatory sequence, but preferably in a 5'-regulatory sequence of a mammalian PG1 gene, more preferably SEQ ID NO: 180 or in an exon of the PG1 genomic sequence or within the PG1 cDNA of SEQ ID NOs 3, 112–125, or 184.

A first preferred DNA construct is based on the tetracycline resistance operon tet from *E. coli* transposon Tn110 for controlling the PG1 gene expression, such as described by Gossen M. et al., 1992, Proc. Natl. Acad. Sci. USA, 89: 5547–5551; Gossen M. et al., 1995, Science, 268: 1766–1769; and Furth P. A. et al., 1994, Proc. Natl Acad. Sci USA, 91: 9302–9306. Such a DNA construct contains seven tet operator sequences from Tn10 (tetop) that are fused to either a minimal promoter or a 5'-regulatory sequence of the PG1 gene, said minimal promoter or said PG1 regulatory sequence being operably linked to a polynucleotide of interest that codes either for a sense or an antisense oligonucleotide or for a polypeptide, including a PG1 polypeptide or a peptide fragment thereof. This DNA construct is functional as a conditional expression system for the nucleotide sequence of interest when the same cell also comprises a nucleotide sequence coding for either the wild type (tTA) or the mutant (rTA) repressor fused to the activating domain of viral protein VP16 of herpes simplex virus, placed under the control of a promoter, such as the HCMVIE1 enhancer/promoter or the MMTV-LTR. Indeed, a preferred DNA construct of the invention will comprise both the polynucleotide containing the tet operator sequences and the polynucleotide containing a sequence coding for the tTA or the rTA repressor.

In the specific embodiment wherein the conditional expression DNA construct contains the sequence encoding the mutant tetracycline repressor rTA, the expression of the polynucleotide of interest is silent in the absence of tetracycline and induced in its presence.

DNA Constructs Allowing Homologous Recombination: Replacement Vectors

A second preferred DNA construct will comprise, from 5'-end to 3'-end: (a) a first nucleotide sequence that is comprised of a PG1 sequence preferably a PG1 genomic sequence; (b) a nucleotide sequence comprising a positive selection marker, such as the marker for neomycin resistance (neo); and (c) a second nucleotide sequence that comprised of a PG1 sequence preferably a PG1 genomic sequence, and is located on the genome downstream the first PG1 nucleotide sequence (a).

In a preferred embodiment, this DNA construct also comprises a negative selection marker located upstream the nucleotide sequence (a) or downstream the nucleotide sequence (b). Preferably, the negative selection marker consists of the thymidine kinase (tk) gene (Thomas K. R. et al., 1986, Cell, 44: 419–428), the hygromycin beta gene (Te Riele et al., 1990, Nature, 348: 649–651), the hprt gene (Van der Lugt et al., 1991, Gene, 105: 263–267; and Reid L. H. et al., 1990, Proc. Natl. Acad. Sci. USA, 87: 4299–4303) or the Diphteria toxin A fragment (Dt-A) gene (Nada S. et al., 1993, Cell, 73: 1125–1135; Yagi T. et al., 1990, Proc. Natl. Acad. Sci. USA, 87: 9918–9922). Preferably, the positive selection marker is located within a PG1 exon sequence so as to interrupt the sequence encoding a PG1 protein.

These replacement vectors are described for example by Thomas K. R. et al., 1986, Cell, 44: 419–428; Thomas K. R. et al., 1987, Cell, 51: 503–512; Mansour S. L. et al., 1988, Nature, 336: 348–352; and Koller et al., 1992, Annu. Rev. Immunol., 10: 705–30.

The first and second nucleotide sequences (a) and (c) is located at any point within a PG1 regulatory sequence, an intronic sequence, an exon sequence or a sequence containing both regulatory and/or intronic and/or exon sequences. The length of nucleotide sequences (a) and (c) is determined empirically by one of ordinary skill in the art. Nucleotide sequences (a) and (c) or any length are specifically contemplated in the present invention, however, lengths ranging from 1 kb to 50 kb, preferably from 1 kb to 10 kb, more preferably from 2 kb to 6 kb and most preferably from 2 kb to 4 kb are normally used.

DNA Constructs Allowing Homologous Recombination: Cre-loxP System.

These new DNA constructs make use of the site-specific recombination system of the P1 phage. The P1 phage possesses a recombinase called Cre which interacts specifically with a 34 base pairs loxP site. The loxP site is composed of two palindromic sequences of 13 bp separated by a 8 bp conserved sequence (Hoess et al., 1986, Nucleic Acids Res., 14: 2287–2300). The recombination by the Cre enzyme between two loxP sites having an identical orientation leads to the deletion of the DNA fragment.

The Cre-loxP system used in combination with a homologous recombination technique has been first described by Gu H. et al., 1993, Cell, 73: 1155–1164; and Gu H. et al., 1994, Science, 265: 103–106. Briefly, a nucleotide sequence of interest to be inserted in a targeted location of the genome harbors at least two loxP sites in the same orientation and located at the respective ends of a nucleotide sequence to be excised from the recombinant genome. The excision event requires the presence of the recombinase (Cre) enzyme within the nucleus of the recombinant host cell. The recombinase enzyme is brought at the desired time either by (a) incubating the recombinant host cells in a culture medium containing this enzyme, by injecting the Cre enzyme directly into the desired cell, such as described by Araki K. et al., 1995, Proc. Natl. Acad. Sci. USA, 92: 160–164; or by lipofection of the enzyme into the cells, such as described by Baubonis et al., 1993, Nucleic Acids Res., 21: 2025–2029; (b) transfecting the cell host with a vector comprising the Cre coding sequence operably linked to a promoter functional in the recombinant cell host, which promoter being optionally inducible, said vector being introduced in the recombinant cell host, such as described by Gu H. et al., 1993, Cell, 73: 1155–1164; and Sauer B. et al., 1988, Proc. Natl. Acad. Sci. USA, 85: 5166–5170; (c) introducing in the genome of the host cell a polynucleotide comprising the Cre coding sequence operably linked to a promoter functional in the recombinant cell host, which promoter is optionally inducible, and said polynucleotide being inserted in the genome of the cell host either by a random insertion event or an homologous recombination event, such as described by Gu H. et al., 1994, Science, 265: 103–106.

In the specific embodiment wherein the vector containing the sequence to be inserted in the PG1 gene by homologous recombination is constructed in such a way that selectable markers are flanked by loxp sites of the same orientation, it is possible, by treatment by the Cre enzyme, to eliminate the selectable markers while leaving the PG1 sequences of interest that have been inserted by an homologous recombination event. Again, two selectable markers are needed: a positive selection marker to select for the recombination event and a negative selection marker to select for the homologous recombination event. Vectors and methods using the Cre-loxP system are described by Zou Y. R. et al., 1994, Curr. Biol., 4: 1099–1103.

Thus, a third preferred DNA construct of the invention comprises, from 5'-end to 3'-end: (a) a first nucleotide sequence that is comprised of a PG1 sequence, preferably a PG1 genomic sequence; (b) a nucleotide sequence comprising a polynucleotide encoding a positive selection marker, such as the marker for neomycin resistance (neo), said nucleotide sequence comprising additionally two sequences defining a site recognized by a recombinase, such as a loxP site, the two sites being placed in the same orientation; and (c) a second nucleotide sequence that is comprised of a PG1 sequence, preferably a PG1 genomic sequence, and is located on the genome downstream of the first PG1 nucleotide sequence (a).

The sequences defining a site recognized by a recombinase, such as a loxP site, are preferably located within the nucleotide sequence (b) at suitable locations bordering the nucleotide sequence for which the conditional excision is sought. In one specific embodiment, two loxP sites are located at each side of the positive selection marker sequence, in order to allow its excision at a desired time after the occurrence of the homologous recombination event.

In a preferred embodiment of a method using the third DNA construct described above, the excision of the polynucleotide fragment bordered by the two sites recognized by a recombinase, preferably two loxP sites, is performed at a desired time, due to the presence within the genome of the recombinant host cell of a sequence encoding the Cre enzyme operably linked to a promoter sequence, preferably an inducible promoter, more preferably a tissue-specific promoter sequence and most preferably a promoter sequence which is both inducible and tissue-specific, such as described by Gu H. et al., 1994, Science, 265: 103–106.

The presence of the Cre enzyme within the genome of the recombinant cell host may result of the breeding of two transgenic animals, the first transgenic animal bearing the PG1-derived sequence of interest containing the loxP sites as described above and the second transgenic animal bearing the Cre coding sequence operably linked to a suitable promoter sequence, such as described by Gu H. et al., 1994, Science, 265: 103–106. Spatio-temporal control of the Cre enzyme expression may also be achieved with an adenovirus based vector that contains the Cre gene thus allowing infection of cells, or in vivo infection of organs, for delivery of the Cre enzyme, such as described by Anton M. et al., 1995, J. Virol., 69: 4600–4606; and Kanegae Y. et al., 1995, Nucl. Acids Res., 23: 3816–3821.

The DNA constructs described above is used to introduce a desired nucleotide sequence of the invention, preferably a PG1 genomic sequence or a PG1 cDNA sequence, and most preferably an altered copy of a PG1 genomic or cDNA sequence, within a predetermined location of the targeted genome, leading either to the generation of an altered copy of a targeted gene (knock-out homologous recombination) or to the replacement of a copy of the targeted gene by another copy sufficiently homologous to allow an homologous recombination event to occur (knock-in homologous recombination).

Nuclear Antisense DNA Constructs

Preferably, the antisense polynucleotides of the invention have a 3' polyadenylation signal that has been replaced with a self-cleaving ribozyme sequence, such that RNA polymerase II transcripts are produced without poly(A) at their 3' ends, these antisense polynucleotides being incapable of export from the nucleus, such as described by Liu Z. et al., 1994, Proc. Natl. Acad. Sci. USA, 91: 4528–4262. In a preferred embodiment, these PG1 antisense polynucleotides also comprise, within the ribozyme cassette, a histone stem-loop structure to stabilize cleaved transcripts against 3'–5' exonucleolytic degradation, such as described by Eckner R. et al., 1991, EMBO J., 10: 3513–3522.

Expression Vectors

The polynucleotides of the invention also include expression vectors. Expression vector systems, control sequences and compatible host are known in the art. For a review of these systems see, for example, U.S. Pat. No. 5,350,671, columns 45–48. Any of the standard methods known to those skilled in the art for the insertion of DNA fragments into a vector is used to construct expression vectors containing a chimeric gene consisting of appropriate transcriptional/translational control signals and the protein coding sequences. These methods may include in vitro recombinant DNA and synthetic techniques and in vivo recombinants (genetic recombination).

Expression of a polypeptide, peptide or derivative, or analogs thereof encoded by a polynucleotide sequence in SEQ ID NOs: 3, 69, 100–112, or 179–184 is regulated by a second nucleic acid sequence so that the protein or peptide is expressed in a host transformed with the recombinant DNA molecule. For example, expression of a protein or peptide is controlled by any promoter/enhancer element known in the art. Promoters which is used to control expression include, but are not limited to, the CMV promoter, the SV40 early promoter region (Bemoist and Chambon, 1981, Nature 290:304–310), the promoter contained in the 3' long terminal repeat of Rous sarcoma virus (Yamamoto, et al., 1980, Cell 22:787–797), the herpes thymidine kinase promoter (Wagner et al., 1981, Proc. Natl. Acad. Sci. U.S.A. 78:1441–1445), the regulatory sequences of the metallothionein gene (Brinster et al., 1982, Nature 296: 39–42); prokaryotic expression vectors such as the beta-lactamase promoter (Villa-Kamaroff, et al., 1978, Proc. Natl. Acad. Sci. U.S.A. 75:3727–3731), or the tac promoter (DeBoer, et al., 1983, Proc. Natl. Acad. Sci. U.S.A. 80:21–25); see also "Useful proteins from recombinant bacteria" in Scientific American, 1980, 242:74–94; plant expression vectors comprising the nopaline synthetase promoter region (Herrera-Estrella et al., 1983, Nature 303: 209–213) or the cauliflower mosaic virus 35S RNA promoter (Gardner, et al., 1981, Nucl. Acids Res. 9:2871), and the promoter of the photosynthetic enzyme ribulose biphosphate carboxylase (Herrera-Estrella et al., 1984, Nature 310:115–120); promoter elements from yeast or other fungi such as the Gal 4 promoter, the ADC (alcohol dehydrogenase) promoter, PGK (phosphoglycerol kinase) promoter, alkaline phosphatase promoter, and the following animal transcriptional control regions, which exhibit tissue specificity and have been utilized in transgenic animals: elastase I gene control region which is active in pancreatic acinar cells (Swift et al., 1984, Cell 38:639–646; Ornitz et al., 1986, Cold Spring Harbor Symp. Quant. Biol. 50:399–409; MacDonald, 1987, Hepatology 7:425–515); insulin gene control region which is active in pancreatic beta cells (Hanahan, 1985, Nature 315:115–122), immunoglobulin gene control region which is active in lymphoid cells (Grosschedl et al., 1984, Cell 38:647–658; Adames et al., 1985, Nature 318: 533–538; Alexander et al., 1987, Mol. Cell. Biol. 7:1436–1444), mouse mammary tumor virus control region which is active in testicular, breast, lymphoid and mast cells (Leder et al., 1986, Cell 45:485–495), albumin gene control region which is active in liver (Pinkert et al., 1987, Genes and Devel. 1:268–276), alpha-fetoprotein gene control region which is active in liver (Krumlauf et al., 1985, Mol. Cell. Biol. 5:1639–1648; Hammer et al., 1987, Science 235:53–58; alpha 1-antitrypsin gene control region which is active in the liver (Kelsey et al., 1987, Genes and Devel. 1:161–171), beta-globin gene control region which is active in myeloid cells (Mogram et al., 1985, Nature 315:338–340; Kollias et al., 1986, Cell 46:89–94; myelin basic protein gene control region which is active in oligodendrocyte cells in the brain (Readhead et al., 1987, Cell 48:703–712); myosin light chain-2 gene control region which is active in skeletal muscle (Sani, 1985, Nature 314:283–286), and gonadotropic releasing hormone gene control region which is active in the hypothalamus (Mason et al., 1986, Science 234:1372–1378).

Other suitable vectors, particularly for the expression of genes in mammalian cells, is selected from the group of vectors consisting of P1 bacteriophages, and bacterial artificial chromosomes (BACs). These types of vectors may contain large inserts ranging from about 80–90 kb (P1 bacteriophage) to about 300 kb (BACs).

P1 Bacteriophage

The construction of P1 bacteriophage vectors such as p158 or p158/neo8 are notably described by Sternberg N. L., 1992, Trends Genet., 8: 1–16; and Stemberg N. L., 1994, Mamm. Genome, 5: 397–404. Recombinant P1 clones comprising PG1 nucleotide sequences is designed for inserting large polynucleotides of more than 40 kb (Linton M. F. et al., 1993, J. Clin. Invest., 92: 3029–3037). To generate P1 DNA for transgenic experiments, a preferred protocol is the protocol described by McCormick et al., 1994, Genet. Anal. Tech. Appl., 11: 158–164. Briefly, E. coli (preferably strain NS3529) harboring the P1 plasmid are grown overnight in a suitable broth medium containing 25 μg/ml of kanamycin. The P1 DNA is prepared from the E. coli by alkaline lysis using the Qiagen Plasmid Maxi kit (Qiagen, Chatsworth, Calif., USA), according to the manufacturer's instructions. The P1 DNA is purified from the bacterial lysate on two Qiagen-tip 500 columns, using the washing and elution buffers contained in the kit. A phenol/chloroform extraction is then performed before precipitating the DNA with 70% ethanol. After solubilizing the DNA in TE (10 mM Tris-HCl, pH 7.4, 1 mM EDTA), the concentration of the DNA is assessed by spectrophotometry.

When the goal is to express a P1 clone comprising PG1 nucleotide sequences in a transgenic animal, typically in transgenic mice, it is desirable to remove vector sequences from the P1 DNA fragment, for example by cleaving the P1 DNA at rare-cutting sites within the P1 polylinker (SfiI, NotI or SalI). The P1 insert is then purified from vector sequences on a pulsed-field agarose gel, using methods similar using methods similar to those originally reported for the isolation of DNA from YACs (Schedl A. et al., 1993, Nature, 362: 258–261; and Peterson et al., 1993, Proc. Natl. Acad. Sci. USA, 90: 7593–7597). At this stage, the resulting purified insert DNA can be concentrated, if necessary, on a Millipore Ultrafree-MC Filter Unit (Millipore, Bedford, Mass., USA—30,000 molecular weight limit) and then dialyzed against microinjection buffer (10 mM Tris-HCl, pH 7.4; 250 μM EDTA) containing 100 mM NaCl, 30 μM spermine, 70 μM spermidine on a microdyalisis membrane (type VS, 0.025 μM from Millipore). The intactness of the purified P1 DNA insert is assessed by electrophoresis on 1% agarose (Sea Kem GTG; FMC Bio-products) pulse-field gel and staining with ethidium bromide.

Bacterial Artificial Chromosomes (BACs)

The bacterial artificial chromosome (BAC) cloning system (Shizuya et al., 1992, Proc. Natl. Acad. Sci. USA, 89: 8794–8797) has been developed to stably maintain large fragments of genomic DNA (100–300 kb) in E. coli. A preferred BAC vector consists of pBeloBAC11 vector that has been described Kim U. J., et al., 1996, Genomics, 34: 213–218. BAC libraries are prepared with this vector using size-selected genomic DNA that has been partially digested using enzymes that permit ligation into either the Bam HI or Hind III sites in the vector. Flanking these cloning sites are T7 and SP6 RNA polymerase transcription initiation sites that can be used to generate end probes by either RNA transcription or PCR methods. After the construction of a BAC library in E. coli, BAC DNA is purified from the host cell as a supercoiled circle. Converting these circular molecules into a linear form precedes both size determination and introduction of the BACs into recipient cells. The cloning site is flanked by two Not I sites, permitting cloned segments to be excised from the vector by Not I digestion. Alternatively, the DNA insert contained in the pBeloBAC11 vector is linearized by treatment of the BAC vector with the commercially available enzyme lambda terminase that leads to the cleavage at the unique cosN site, but this cleavage method results in a full length BAC clone containing both the insert DNA and the BAC sequences.

Host Cells

The PG1 gene expression in human cells is rendered defective, or alternatively it is proceeded with the insertion of a PG1 genomic or cDNA sequence with the replacement of the PG1 gene counterpart in the genome of an animal cell by a PG1 polynucleotide according to the invention. These genetic alterations is generated by homologous recombination events using specific DNA constructs that have been previously described.

One kind of host cell that is used are mammal zygotes, such as murine zygotes. For example, murine zygotes may undergo microinjection with a purified DNA molecule of interest, for example a purified DNA molecule that has previously been adjusted to a concentration range from 1 ng/ml—for BAC inserts—3 ng/μl—for P1 bacteriophage inserts—in 10 mM Tris-HCl, pH 7.4, 250 μM EDTA containing 100 mM NaCl, 30 μM spermine, and 70 μM spermidine. When the DNA to be microinjected has a large size, polyamines and high salt concentrations can be used in order to avoid mechanical breakage of this DNA, as described by Schedl et al., 1993, Nucleic Acids Res., 21: 4783–4787.

Anyone of the polynucleotides of the invention, including the DNA constructs described herein, is introduced in an embryonic stem (ES) cell line, preferably a mouse ES cell line. ES cell lines are derived from pluripotent, uncommitted cells of the inner cell mass of pre-implantation blastocysts. Preferred ES cell lines are the following : ES-E14TG2a (ATCC No. CRL-1821), ES-D3 (ATCC No. CRL1934 and No. CRL-11632), YS001 (ATCC No. CRL-11776), 36.5 (ATCC No. CRL-11116). To maintain ES cells in an uncommitted state, they are cultured in the presence of growth inhibited feeder cells which provide the appropriate signals to preserve this embryonic phenotype and serve as a matrix for ES cell adherence. Preferred feeder cells consist of primary embryonic fibroblasts that are established from tissue of day 13-day 14 embryos of virtually any mouse strain, that are maintained in culture, such as described by Abbondanzo S J et al., 1993, Methods in Enzymology, Academic Press, New York, pp. 803–823; and are inhibited in growth by irradiation, such as described by Robertson E., 1987, Embryo-derived stem cell lines. E. J. Robertson Ed. Teratocarcinomas and embrionic stem cells: a practical approach. IRL Press, Oxford, pp. 71, or by the presence of an inhibitory concentration of LIF, such as described by Pease S. and William R. S., 1990, Exp. Cell. Res., 190: 209–211.

Transgenic Animals

The terms "transgenic animals" or "host animals" are used herein designate non-human animals that have their genome genetically and artificially manipulated so as to include one of the nucleic acids according to the invention. Preferred animals are non-human mammals and include those belonging to a genus selected from Mus (e.g. mice), Rattus (e.g. rats) and Oryctogalus (e.g. rabbits) which have their genome artificially and genetically altered by the insertion of a nucleic acid according to the invention.

The transgenic animals of the invention all include within a plurality of their cells a cloned recombinant or synthetic DNA sequence, more specifically one of the purified or isolated nucleic acids comprising a PG1 coding sequence, a PG1 regulatory polynucleotide or a DNA sequence encoding an antisense polynucleotide such as described in the present specification.

Preferred transgenic animals according to the invention contains in their somatic cells and/or in their germ line cells a polynucleotide selected from the following group of polynucleotides:

a) non-native, purified or isolated nucleic acid encoding a PG1 polypeptide, or a polypeptide fragment or variant thereof.

b) a non-native, purified or isolated nucleic comprising at least 8 consecutive nucleotides of the nucleotide sequence SEQ ID NOs: 179, 182, or 183, a nucleotide sequence complementary; in some embodiments, the length of the fragments can range from at least 8, 10, 15, 20 or 30 to 200 nucleotides, preferably from at least 10 to 50 nucleotides, more preferably from at least 40 to 50 nucleotides of SEQ ID NOs: 179, 182, or 183, or the sequence complementary thereto. In some embodiments, the fragments may comprise more than 200 nucleotides of SEQ ID NOs: 179, 182, or 183, or the sequence complementary thereto.

c) a non-native, purified or isolated nucleic acid comprising at least 8 consecutive nucleotides of the nucleotide sequence SEQ ID NOs: 3, 69, 112–125 or 184, a sequence complementary thereto or a variant thereof; In some embodiments, the length of the fragments can range from at least 8, 10, 15, 20 or 30 to 200 nucleotides, preferably from at least 10 to 50 nucleotides, more preferably from at least 40 to 50 nucleotides of SEQ ID NOs: 3, 69, 112–125 or 184, or the sequence complementary thereto. In some embodiments, the fragments may comprise more than 200 nucleotides of SEQ ID NOs: 3, 69, 112–125 or 184, or the sequence complementary thereto.

d) a non-native, purified or isolated nucleic acid comprising a nucleotide sequence selected from the group of SEQ ID NOs: 100 to 111, a sequence complementary thereto or a fragment or a variant thereof.

e) a non-native, purified or isolated nucleic acid comprising a combination of at least two polynucleotides selected from the group consisting of SEQ ID NOs: 100 to 111, or the sequences complementary thereto wherein the polynucleotides are arranged within the nucleic acid, from the 5' end to the 3' end of said nucleic acid, in the same order than in SEQ NOs: 179, 182, or 183.

f) a non-native, purified or isolated nucleic acid comprising the nucleotide sequence SEQ ID NO: 180, or the sequences complementary thereto or a biologically active fragment or variant of the nucleotide sequence of SEQ ID NO: 180, or the sequence complementary thereto.

g) a non-native, purified or isolated nucleic acid comprising the nucleotide sequence SEQ ID NO: 181, or the sequence complementary thereto or a biologically active fragment or variant of the nucleotide sequence of SEQ ID NO: 181 or the sequence complementary thereto.

h) a polynucleotide consisting of:
(1) a nucleic acid comprising a regulatory polynucleotide of SEQ ID NO: 180 or the sequences complementary thereto or a biologically active fragment or variant thereof
(2) a polynucleotide encoding a desired polypeptide or nucleic acid.
(3) Optionally, a nucleic acid comprising a regulatory polynucleotide of SEQ NO: 181, or the sequence complementary thereto or a biologically active fragment or variant thereof.

i) a DNA construct as described previously in the present specification.

The transgenic animals of the invention thus contain specific sequences of exogenous genetic material or "non-native" such as the nucleotide sequences described above in detail.

In a first preferred embodiment, these transgenic animals is good experimental models in order to study the diverse pathologies related to cell differentiation, in particular concerning the transgenic animals within the genome of which has been inserted one or several copies of a polynucleotide encoding a native PG1 protein, or alternatively a mutant PG1 protein.

In a second preferred embodiment, these transgenic animals may express a desired polypeptide of interest under the control of the regulatory polynucleotides of the PG1 gene, leading to good yields in the synthesis of this protein of interest, and eventually a tissue specific expression of this protein of interest.

The design of the transgenic animals of the invention is made according to the conventional techniques well known from the one skilled in the art. For more details regarding the production of transgenic animals, and specifically transgenic mice, it is referred to Sandou et al. (1994) and also to U.S. Pat. No. 4,873,191, issued Oct. 10, 1989, U.S. Pat. No. 5,464,764 issued Nov. 7, 1995 and U.S. Pat. No. 5,789,215, issued Aug. 4, 1998, these documents being herein incorporated by reference to disclose methods producing transgenic mice.

Transgenic animals of the present invention are produced by the application of procedures which result in an animal with a genome that has incorporated exogenous genetic material. The procedure involves obtaining the genetic material, or a portion thereof, which encodes either a PG1 coding sequence, a PG1 regulatory polynucleotide or a DNA sequence encoding a PG1 antisense polynucleotide such as described in the present specification.

A recombinant polynucleotide of the invention is inserted into an embryonic or ES stem cell line. The insertion is preferably made using electroporation, such as described by Thomas K. R. et al., 1987, Cell, 51: 503–512. The cells subjected to electroporation are screened (e.g. by selection via selectable markers, by PCR or by Southern blot analysis) to find positive cells which have integrated the exogenous recombinant polynucleotide into their genome, preferably via an homologous recombination event. An illustrative positive-negative selection procedure that is used according to the invention is described by Mansour S. L. et al., 1988, Nature, 336: 348–352.

Then, the positive cells are isolated, cloned and injected into 3.5 days old blastocysts from mice, such as described by Bradley A., 1987, Production and analysis of chimaeric mice. In: E. J. Robertson (Ed.), Teratocarcinomas and embryonic stem cells: A practical approach. IRL Press, Oxford, pp. 113. The blastocysts are then inserted into a female host animal and allowed to grow to term.

Alternatively, the positive ES cells are brought into contact with embryos at the 2.5 days old 8-16 cell stage (morulae) such as described by Wood S. A. et al., 1993, Proc. Natl. Acad. Sci. USA, 90: 4582–4585; or by Nagy A. et al., 1993, Proc. Natl. Acad. Sci. USA, 90: 8424–8428. The ES cells being internalized to colonize extensively the blastocyst including the cells which will give rise to the germ line. The offspring of the female host are tested to determine which animals are transgenic e.g. include the inserted exogenous DNA sequence and which are wild-type.

Thus, the present invention also concerns a transgenic animal containing a nucleic acid, a recombinant expression vector or a recombinant host cell according to the invention.

Recombinant Cell Lines Derived from the Transgenic Animals of the Invention.

A further object of the invention consists of recombinant host cells obtained from a transgenic animal described herein.

Recombinant cell lines is established in vitro from cells obtained from any tissue of a transgenic animal according to the invention, for example by transfection of primary cell cultures with vectors expressing onc-genes such as SV40 large T antigen, as described by Chou J. Y., 1989, Mol. Endocrinol., 3: 1511–1514; and Shay J. W. et al., 1991, Biochem. Biophys. Acta, 1072: 1–7.

Functional Analysis of the PG1 Poplypeptides in Transgenic Animals

Using different BACs that contain the PG1 gene, we performed FISH experiment on the adenocarcinoma prostatic cell line PC3. Only one signal could be detected showing that this region of chromosome 8 is hemizygous in this tumoral cell line.

To study the function of PG1, it is inactivate by homologous recombination in the remaining allele of PG1 in the PC3 cell line. To inactivate the remaining PG1 allele, a knock-out targeting vector is generated by inserting two genomic DNA fragments of 3.0 and 4.3 kb (that correspond to a sequence upstream of the PG1 promoter and to part of intron 1, respectively) in the pKO Scrambler Neo TK vector (Lexicon ref V1901). Since the targeting vector contains the neomycine resistance gene as well as the Tk gene, homologous recombination is selected by adding geneticin and FIAU to the medium. The promoter, the transcriptional start site, and the first ATG contained in exon 1 on the recombinant allele is deleted by homologous recombination between the targeting vector and the remaining PG1 allele. Accordingly, no coding transcripts is initiated from the recombinant allele. The parental PC3 cells as well as cells hemizygous for the null allele are assessed for their phenotype, their growth rate in liquid culture, their ability to grow in agar (anchorage-independent growth) as well as their ability to form tumors and metastasis when injected subcutaneously in nude mice.

To determine the function of PG1 in the animal, and to generate an animal model for prostate tumorigenesis, mice in which tissue specific inactivation of the PG1 alleles can be induced are generated. For this purpose, the Cre-loxP system is utilized as described above to allow chromosome engineering to be perform directly in the animal.

First, to generate mice with a conditional null allele, two loxP sites are introduced in the murine genome, the first one 5' to the PG1 promoter and the second one 3' to the PG1 exon 1. Alternatively, to generate subtle mutations or to specifically mutate some isoforms, the loxP sites are introduced so that they flank any of the given exons or any potential set of exons. It is important to note that a functional PG1 messenger can be transcribed from these alleles until a recombination is triggered between the loxp sites by the Cre enzyme.

Second, to generate the inducer mice, the Cre gene is introduced in the mouse genome under the control of a tissue specific promoter, for example under the control of the PSA (prostate specific antigen) promoter.

Finally, tissue specific inactivation of the PG1 gene are induced by generating mice containing the Cre transgene that are homozygous for the recombinant PG1 allele.

Gene Therapy

The present invention also comprises the use of the PG1 genomic DNA sequence of SEQ ID NO: 179, the PG1 cDNA of SEQ ID NO: 3, or nucleic acid encoding a mutant PG1 protein responsible for a detectable phenotype in gene therapy strategies, including antisense and triple helix strategies as described in Examples 19 and 20, below. In antisense approaches, nucleic acid sequences complementary to an mRNA are hybridized to the mRNA intracellularly, thereby blocking the expression of the protein encoded by the mRNA. The antisense sequences may prevent gene expression through a variety of mechanisms. For example, the antisense sequences may inhibit the ability of ribosomes to translate the mRNA. Alternatively, the antisense sequences may block transport of the mRNA from the nucleus to the cytoplasm, thereby limiting the amount of mRNA available for translation. Another mechanism through which antisense sequences may inhibit gene expression is by interfering with mRNA splicing. In yet another strategy, the antisense nucleic acid is incorporated in a ribozyme capable of specifically cleaving the target mRNA.

EXAMPLE 19

Preparation and Use of Antisense Oligonucleotides

The antisense nucleic acid molecules to be used in gene therapy is either DNA or RNA sequences. They may comprise a sequence complementary to the sequence of the PG1 genomic DNA of SEQ ID NO: 179, the PG1 cDNA of SEQ ID NO: 3, or a nucleic acid encoding a PG1 protein responsible for a detectable phenoytpe. The antisense nucleic acids should have a length and melting temperature sufficient to permit formation of an intracellular duplex having sufficient stability to inhibit the expression of the PG1 mRNA in the duplex. Strategies for designing antisense nucleic acids suitable for use in gene therapy are disclosed in Green et al., Ann. Rev. Biochem. 55:569–597 (1986) and Izant and Weintraub, Cell 36:1007–1015 (1984).

In some strategies, antisense molecules are obtained by reversing the orientation of the PG1 coding region with respect to a promoter so as to transcribe the opposite strand from that which is normally transcribed in the cell. The antisense molecules is transcribed using in vitro transcription systems such as those which employ T7 or SP6 polymerase to generate the transcript. Another approach involves transcription of PG1 antisense nucleic acids in vivo by operably linking DNA containing the antisense sequence to a promoter in an expression vector.

Alternatively, oligonucleotides which are complementary to the strand of the PG1 gene normally transcribed in the cell is synthesized in vitro. Thus, the antisense PG1 nucleic acids are complementary to the PG1 mRNA and are capable of hybridizing to the mRNA to create a duplex. In some embodiments, the PG1 antisense sequences may contain modified sugar phosphate backbones to increase stability and make them less sensitive to RNase activity. Examples of modifications suitable for use in antisense strategies are described by Rossi et al., Pharmacol. Ther. 50(2):245–254, (1991).

Various types of antisense oligonucleotides complementary to the sequence of the PG1 genomic DNA of SEQ ID NO: 179, the PG1 cDNA of SEQ ID NO: 3, or a nucleic acid encoding a PG1 protein responsible for a detectable phenoytpe is used. In one preferred embodiment, stable and semi-stable antisense oligonucleotides as described in International Application No. PCT WO94/23026, are used to inhibit the expression of the PG1 gene. In these molecules, the 3' end or both the 3' and 5' ends are engaged in intramolecular hydrogen bonding between complementary base pairs. These molecules are better able to withstand exonuclease attacks and exhibit increased stability compared to conventional antisense oligonucleotides.

In another preferred embodiment, the antisense oligodeoxynucleotides described in International Application No. WO 95/04141, are used to inhibit expression of the PG1 gene.

In yet another preferred embodiment, the covalently cross4inked antisense oligonucleotides described in International Application No. WO 96/31523, are used to inhibit expression of the PG1 gene. These double- or single-stranded oligonucleotides comprise one or more, respectively, inter- or intra-oligonucleotide covalent cross-linkages, wherein the linkage consists of an amide bond between a primary amine group of one strand and a carboxyl group of the other strand or of the same strand, respectively, the primary amine group being directly substituted in the 2' position of the strand nucleotide monosaccharide ring, and the carboxyl group being carried by an aliphatic spacer group substituted on a nucleotide or nucleotide analog of the other strand or the same strand, respectively.

The antisense oligodeoxynucleotides and oligonucleotides disclosed in International Application No. WO 92/18522, may also be used to inhibit the expression of the PG1 gene. These molecules are stable to degradation and contain at least one transcription control recognition sequence which binds to control proteins and are effective as decoys therefor. These molecules may contain "hairpin" structures, "dumbbell" structures, "modified dumbbell" structures, "cross-linked" decoy structures and "loop" structures.

In another preferred embodiment, the cyclic double-stranded oligonucleotides described in European Patent Application No. 0 572 287 A2, are used to inhibit the expression of the PG1 gene. These ligated oligonucleotide "dumbbells" contain the binding site for a transcription factor which binds to the PG1 promoter and inhibits expression of the gene under control of the transcription factor by sequestering the factor.

Use of the closed antisense oligonucleotides disclosed in International Application No. WO 92/19732, is also contemplated. Because these molecules have no free ends, they are more resistant to degradation by exonucleases than are conventional oligonucleotides. These oligonucleotides is multifunctional, interacting with several regions which are not adjacent to the target mRNA.

The appropriate level of antisense nucleic acids required to inhibit PG1 gene expression is determined using in vitro expression analysis. The antisense molecule is introduced into the cells by diffusion, injection, infection or transfection using procedures known in the art. For example, the antisense nucleic acids can be introduced into the body as a bare or naked oligonucleotide, oligonucleotide encapsulated in lipid, oligonucleotide sequence encapsidated by viral protein, or as an oligonucleotide operably linked to a promoter contained in an expression vector. The expression vector is any of a variety of expression vectors known in the art, including retroviral or viral vectors, vectors capable of extrachromosomal replication, or integrating vectors. The vectors is DNA or RNA.

The PG1 antisense molecules are introduced onto cell samples at a number of different concentrations preferably between $1 \times 10^{-10}$M to $1 \times 10^{-4}$M. Once the minimum concentration that can adequately control gene expression is identified, the optimized dose is translated into a dosage suitable for use in vivo. For example, an inhibiting concentration in culture of $1 \times 10^{-7}$ translates into a dose of approximately 0.6 mg/kg bodyweight. Levels of oligonucleotide approaching 100 mg/kg bodyweight or higher is possible after testing the toxicity of the oligonucleotide in laboratory animals. It is additionally contemplated that cells from the vertebrate are removed, treated with the antisense oligonucleotide, and reintroduced into the vertebrate.

It is further contemplated that the PG1 antisense oligonucleotide sequence is incorporated into a ribozyme sequence to enable the antisense to specifically bind and cleave its target mRNA. For technical applications of ribozyme and antisense oligonucleotides see Rossi et al., supra.

In a preferred application of this invention, antibody-mediated tests such as RIAs and ELISA, functional assays, or radiolabeling are used to determine the effectiveness of antisense inhibition on PG1 expression.

The PG1 cDNA, the PG1 genomic DNA, and the PG1 alleles of the present invention may also be used in gene therapy approaches based on intracellular triple helix formation. Triple helix oligonucleotides are used to inhibit transcription from a genome. They are particularly useful for studying alterations in cell activity as it is associated with a particular gene. The PG1 cDNA, PG1 genomic DNA, or PG1 allele of the present invention or, more preferably, a portion of those sequences, can be used to inhibit gene expression in individuals suffering from prostate cancer or another detectable phenotype or individuals at risk for developing prostate cancer or another detectable phenotype at a later date as a result of their PG1 genotype. Similarly, a portion of the PG1 cDNA, the PG1 genomic DNA, or the PG1 alleles can be used to study the effect of inhibiting PG1 transcription within a cell. Traditionally, homopurine sequences were considered the most useful for triple helix strategies, such as those described in Example 20, below. However, homopyrimidine sequences can also inhibit gene expression. Such homopyrimidine oligonucleotides bind to the major groove at homopurine:homopyrimidine sequences. Thus, both types of sequences from the PG1 cDNA, the PG1 genomic DNA, and the PG1 alleles are contemplated within the scope of this invention.

EXAMPLE 20

The sequences of the PG1 cDNA, the PG1 genomic DNA, and the PG1 alleles are scanned to identify 10-mer to 20-mer homopyrimidine or homopurine stretches which could be used in triple-helix based strategies for inhibiting PG1 expression. Following identification of candidate homopyrimidine or homopurine stretches, their efficiency in inhibiting PG1 expression is assessed by introducing varying amounts of oligonucleotides containing the candidate sequences into tissue culture cells which express the PG1 gene. The oligonucleotides is prepared on an oligonucleotide synthesizer or they is purchased commercially from a company specializing in custom oligonucleotide synthesis, such as GENSET, Paris, France.

The oligonucleotides is introduced into the cells using a variety of methods known to those skilled in the art, including but not limited to calcium phosphate precipitation, DEAE-Dextran, electroporation, liposome-mediated transfection or native uptake.

Treated cells are monitored for altered cell function or reduced PG1 expression using techniques such as Northern blotting, RNase protection assays, or PCR based strategies to monitor the transcription levels of the PG1 gene in cells which have been treated with the oligonucleotide.

The oligonucleotides which are effective in inhibiting gene expression in tissue culture cells may then be introduced in vivo using the techniques described above and in Example 19 at a dosage calculated based on the in vitro results, as described in Example 19.

In some embodiments, the natural (beta) anomers of the oligonucleotide units can be replaced with alpha anomers to render the oligonucleotide more resistant to nucleases. Further, an intercalating agent such as ethidium bromide, or the like, can be attached to the 3' end of the alpha oligonucleotide to stabilize the triple helix. For information on the generation of oligonucleotides suitable for triple helix formation see Griffin et al. (Science 245:967–971 (1989)).

Alternatively, the PG1 cDNA, the PG1 genomic DNA, and the PG1 alleles of the present invention is used in gene therapy approaches in which expression of the PG1 protein is beneficial, as described in Example 21 below.

EXAMPLE 21

The PG1 cDNA, the PG1 genomic DNA, and the PG1 alleles of the present invention may also be used to express the PG1 protein or a portion thereof in a host organism to produce a beneficial effect. In such procedures, the PG1 protein is transiently expressed in the host organism or stably expressed in the host organism. The expressed PG1 protein is used to treat conditions resulting from a lack of PG1 expression or conditions in which augmentation of existing levels of PG1 expression is beneficial.

A nucleic acid encoding the PG1 proteins of SEQ ID NO: 4, SEQ ID NO:5, or a PG1 allele is introduced into the host organism. The nucleic acid is introduced into the host organism using a variety of techniques known to those of skill in the art. For example, the nucleic acid is injected into the host organism as naked DNA such that the encoded PG1 protein is expressed in the host organism, thereby producing a beneficial effect.

Alternatively, the nucleic acid encoding the PG1 proteins of SEQ ID NO: 4, SEQ ID NO: 5, or a PG1 allele is cloned into an expression vector downstream of a promoter which is active in the host organism. The expression vector is any of the expression vectors designed for use in gene therapy, including viral or retroviral vectors.

The expression vector is directly introduced into the host organism such that the PG1 protein is expressed in the host organism to produce a beneficial effect. In another approach, the expression vector is introduced into cells in vitro. Cells containing the expression vector are thereafter selected and introduced into the host organism, where they express the PG1 protein to produce a beneficial effect.

IX. Isolation of PG1 cDNA From Nonhuman Mammals

The present invention encompasses mammalian PG1 sequences including genomic and cDNA sequences, as well as polypeptide sequences. The present invention also encompasses the use of PG1 genomic and cDNA sequences of the invention, including SEQ ID NOs: 179, 3, 182, and 183, in methods of isolating and characterizing PG1 nucleotide sequences derived from nonhuman mammals, in addition to sequences derived from human sequences. The human and mouse PG1 nucleic acid sequences of the invention can be used to construct primers and probes for amplifying and identifying PG1 genes in other nonhuman animals particularly mammals. The primers and probes used to identify nonhuman PG1 sequences is selected and used for the isolation of nonhuman PG1 utilizing the same techniques described above in Examples 4, 5, 6, 12 and 13.

In addition, sequence analysis of other homologous proteins is used to optimize the sequences of these primers and probes. As described above in the Analysis of the PG1 Protein Sequence, three boxes of homology were identified in the structure of the PG1 protein product when compared to proteins from a diverse range of organisms. See FIG. 9. Using the assumption that the nucleotide sequences for these homologous proteins also show a high degree of homology, it is possible to construct primers that are specific for the PCR amplification of PG1 cDNA in nonhuman mammals.

EXAMPLE 22

The primers BOXIed: AATCATCAAAGCACAGT-TGACTGGAT (SEQ ID NO: 77) and BOXIIIer: ATAAAC-CACCGTAACATCATAAATTGCATCTAA (SEQ ID NO: 78) were designed as PCR primers from the human PG1 sequences after comparison with the sequence homologies of FIG. 9. The BOXIed (SEQ ID NO: 77) and BOXIIIer (SEQ ID NO: 78) primers were used to amplify a mouse PG1 cDNA sequence from mouse liver marathon-ready cDNA (Clontech) under the conditions described above in Example 4. This PCR reaction yielded a product of approximately 400 base pairs, the boxI-boxIII fragment, which was subjected to automated dideoxy terminator sequencing and electrophoresed on ABI 377 sequencers as described above. Sequence analysis confirmed very high homology to human PG1 both at the nucleic acid and protein levels.

Primers were designed for RACE analysis using the 400 base pair boxI-boxIII fragment. Further sequence information was obtained using 5' and 3' RACE reactions on mouse liver marathon cDNA using two sets of these nested PCR primers: moPG1RACE5.350: AATCAAAAGCAACGT-GAGTGGC (SEQ ID NO: 94) and moPG1RACE5.276: GCAAATGCCTGACTGGCTGA (SEQ ID NO: 93) for the 5' RACE reaction and moPG1RACE3.18: CTGCCAGA-CAGGATGCCCTA (SEQ ID NO: 90) and moPG1RACE3.63: ACAAGTTAAAATGGCTTCCGCTG (SEQ ID NO: 91) for the 3' RACE reaction. The PCR products of the RACE reactions were sequenced by primer walking using the following primers:

```
moPGrace3S473:  GAGATAAAAG ATAGGTTGCT CA  (SEQ ID NO: 79);

moPGrace3S526:  AAGAAACAAA TTTCCTGGG       (SEQ ID NO: 80);

moPGrace3S597:  TCTTGGGGAG TTTGACTG        (SEQ ID NO: 81);

moPGrace5R323:  GACCCCGGTG TAGTTCTC        (SEQ ID NO: 82);

moPGrace5R372:  CAGTAAAGCC GGTCGTC         (SEQ ID NO: 83);

moPGrace5R444:  CAGGCCAGCA GGTAGGT         (SEQ ID NO: 84);

moPGrace5R492:  AGCAGGTAGC GCATAGAGT       (SEQ ID NO: 85).
```

Again a high degree of homology between the mouse sequence obtained from the primer walking and the human PG1 sequence was observed. An additional pair of nested primers were designed and utilized to further extend the 3' mouse PG1 sequence in yet another RACE reaction, moPG3RACE2: TGGGCACCTG GTTGTATGGA (SEQ ID NO: 95) and moPG3RACE2n: TCCTTGGCTG CCTGTG-GTTT (SEQ ID NO:96). The PCR product of this final RACE reaction was also sequenced by primer walking using the following primers:

```
moPG1RACE3R94:  CAAATGCATG TTGGCTGT           (SEQ ID NO: 92);
moPG3RACES20:   GATGGCTACA CATTGTATCA C       (SEQ ID NO: 97);
moPG3RACES5:    TCCTGAATTA AATAAGGAGT TTTC    (SEQ ID NO: 98);
moPG3RACES90:   GTTTGTTATT AAAGCATAAG CAAG    (SEQ ID NO: 99).
```

The overlap in the 5' RACE, boxI-boxIII, and 3' RACE fragments allowed a single contiguous coding sequence for the mouse PG1 ortholog to be generated alignment of the three fragments. Primers were chosen from near the 5' and 3' ends of this predicted contiguous sequence (contig) in order to confirm the existence of such a transcript. PCR amplification was performed again on mouse liver marathon-ready cDNA (Clontech) with the chosen primers, moPG15: TGGCGAGCCGAGAGGATG (SEQ ID NO: 87) and moPG13LR2: GGAAACAATGTGATACAATGTG-TAGCC (SEQ ID NO: 86) under the PCR conditions described above in Example 4. The resulting PCR product was a roughly 1.2 kb DNA molecule and was shown to have an identical sequence to that of the deduced contig. Finally modified versions of the moPG15 and moPG13LR2 primers with the addition of EcoRI and BamHI sites, moPG15EcoRI: CGTGAATTCTGGCGAGCCGAGAG-GATG (SEQ ID NO: 89) and moPG15BamI: CGTGGATC-CGGAAACAATGTGATACAATGTGTAGCC (SEQ ID NO: 88) were used to obtain a PCR product that could be cloned into a pSKBluescript plasmid (Stratagene) cleaved with EcoRI and BamHI restriction enzymes. The mouse PG1 cDNA in the resulting construct was subjected to automated dideoxy terminator sequencing and electrophoresed on ABI 377 sequencers as described above. The sequence for mouse PG1 cDNA is reported in SEQ ID NO: 72, and the deduced amino acid sequence corresponding to the cDNA is reported in SEQ ID NO: 74.

EXAMPLE 23

A mouse BAC library was constructed by the cloning of BamHI partially digested DNA of pluripotent embryonic stem cells, cell line ES-E14TG2a (ATCC CRL-1821) into pBeloBACII vector plasmid. Approximately fifty-six thousand clones with an average inset size of 120 kb were picked individually and pooled for PCR screening as described above for human BAC library screening. These pools were screened with STS g34292 derived from the region of the mouse PG1 transcript corresponding to exon6 of the human gene. The upstream and downstream primers defining this STS are: upstream amplification primer for g34292: ATTAAAACAC GTACTGACAC CA (SEQ ID NO: 75), and downstream amplification primer for g34292: AGT-CATGGAT GGTGGATTT (SEQ ID NO: 76). BAC C0281H06 tested positive for hybridizing to g34292. This BAC was isolated and sequenced by sub-cloning into pGen-Del sequencing vector. The resulting partial genomic sequence for mouse PG1 is reported in SEQ ID NO: 73. This process was repeated and the resulting partial genomic sequences for mouse PG1 is reported in SEQ ID NOs: 182 and 183.

Other mammalian PG1 cDNA and genomic sequences can be isolated by the methods of the present invention. PG1 genes in mammalian species have a region of at least 100, preferably 200, more preferably 500 nucleotides in each mammal's most abundant transcription species which has at least 75%, preferably 85%, more preferably 95% sequence homology to the most abundant human or mouse cDNA species (SEQ ID NO: 3). PG1 proteins in mammalian species have a region of at least 40, preferably 90, more preferably 160 amino acids in the deduced amino acid sequence of the most abundant PG1 transcription species which has at least 75%, preferably 85%, more preferably 95% sequence homology to the deduced amino acid sequence of the most abundant human or mouse translations species (SEQ ID NO: 4 or 74).

X. Methods for Genotyping an Individual for Biallelic Markers

Methods are provided to genotype a biological sample for one or more biallelic markers of the present invention, all of which is performed in vitro. Such methods of genotyping comprise determining the identity of a nucleotide at an PG1-related biallelic marker by any method known in the art. These methods find use in genotyping case-control populations in association studies as well as individuals in the context of detection of alleles of biallelic markers which, are known to be associated with a given trait, in which case both copies of the biallelic marker present in individual's genome are determined so that an individual is classified as homozygous or heterozygous for a particular allele.

These genotyping methods can be performed nucleic acid samples derived from a single individual or pooled DNA samples.

Genotyping can be performed using similar methods as those described above for the identification of the biallelic markers, or using other genotyping methods such as those further described below. In preferred embodiments, the comparison of sequences of amplified genomic fragments from different individuals is used to identify new biallelic markers whereas microsequencing is used for genotyping known biallelic markers in diagnostic and association study applications.

X.A. Source of DNA for Genotyping

Any source of nucleic acids, in purified or non-purified form, can be utilized as the starting nucleic acid, provided it contains or is suspected of containing the specific nucleic acid sequence desired. DNA or RNA is extracted from cells, tissues, body fluids. As for the source of genomic DNA to be subjected to analysis, any test sample can be foreseen without any particular limitation. These test samples include biological samples, which can be tested by the methods of the present invention described herein, and include human and animal body fluids such as whole blood, serum, plasma, cerebrospinal fluid, urine, lymph fluids, and various external secretions of the respiratory, intestinal and genitourinary tracts, tears, saliva, milk, white blood cells, myelomas and the like; biological fluids such as cell culture supernatants; fixed tissue specimens including tumor and non-tumor tissue and lymph node tissues; bone marrow aspirates and fixed cell specimens. The preferred source of genomic DNA used in the present invention is from peripheral venous blood of each donor. Techniques to prepare genomic DNA from biological samples are well known to the skilled technician. While nucleic acids for use in the genotyping methods of the invention can be derived from any mammalian source, the test subjects and individuals from which nucleic acid samples are taken are generally understood to be human.

X.B. Amplification Of DNA Fragments Comprising Biallelic Markers

Methods and polynucleotides are provided to amplify a segment of nucleotides comprising one or more biallelic marker of the present invention. It will be appreciated that amplification of DNA fragments comprising biallelic markers is used in various methods and for various purposes and is not restricted to genotyping. Nevertheless, many genotyping methods, although not all, require the previous amplification of the DNA region carrying the biallelic marker of interest. Such methods specifically increase the concentration or total number of sequences that span the biallelic marker or include that site and sequences located either distal or proximal to it. Diagnostic assays may also rely on amplification of DNA segments carrying a biallelic marker of the present invention.

Amplification of DNA is achieved by any method known in the art. The established PCR (polymerase chain reaction) method or by developments thereof or alternatives. Amplification methods which can be utilized herein include but are not limited to Ligase Chain Reaction (LCR) as described in EP A 320 308 and EP A 439 182, Gap LCR (Wolcott, M. J., Clin. Microbiol. Rev. 5:370–386), the so-called "NASBA" or "3SR" technique described in Guatelli J. C. et al. (*Proc. Natl. Acad. Sci. USA* 87:1874–1878, 1990) and in Compton J. (*Nature* 350:91–92, 1991), Q-beta amplification as described in European Patent Application no 4544610, strand displacement amplification as described in Walker et al. (*Clin. Chem.* 42:9–13, 1996) and EP A 684 315 and, target mediated amplification as described in PCT Publication WO 9322461.

LCR and Gap LCR are exponential amplification techniques, both depend on DNA ligase to join adjacent primers annealed to a DNA molecule. In Ligase Chain Reaction (LCR), probe pairs are used which include two primary (first and second) and two secondary (third and fourth) probes, all of which are employed in molar excess to target. The first probe hybridizes to a first segment of the target strand and the second probe hybridizes to a second segment of the target strand, the first and second segments being contiguous so that the primary probes abut one another in 5' phosphate-3'hydroxyl relationship, and so that a ligase can covalently fuse or ligate the two probes into a fused product. In addition, a third (secondary) probe can hybridize to a portion of the first probe and a fourth (secondary) probe can hybridize to a portion of the second probe in a similar abutting fashion. Of course, if the target is initially double stranded, the secondary probes also will hybridize to the target complement in the first instance. Once the ligated strand of primary probes is separated from the target strand, it will hybridize with the third and fourth probes which can be ligated to form a complementary, secondary ligated product. It is important to realize that the ligated products are functionally equivalent to either the target or its complement. By repeated cycles of hybridization and ligation, amplification of the target sequence is achieved. A method for multiplex LCR has also been described (WO 9320227). Gap LCR (GLCR) is a version of LCR where the probes are not adjacent but are separated by 2 to 3 bases.

For amplification of mRNAs, it is within the scope of the present invention to reverse transcribe mRNA into cDNA followed by polymerase chain reaction (RT-PCR); or, to use a single enzyme for both steps as described in U.S. Pat. No. 5,322,770 or, to use Asymmetric Gap LCR (RT-AGLCR) as described by Marshall R. L. et al. (*PCR Methods and Applications* 4:80–84, 1994). AGLCR is a modification of GLCR that allows the amplification of RNA.

Some of these amplification methods are particularly suited for the detection of single nucleotide polymorphisms and allow the simultaneous amplification of a target sequence and the identification of the polymorphic nucleotide as it is further described in X.C.

The PCR technology is the preferred amplification technique used in the present invention. A variety of PCR techniques are familiar to those skilled in the art. For a review of PCR technology, see Molecular Cloning to Genetic Engineering White, B. A. Ed. in *Methods in Molecular Biology* 67: Humana Press, Totowa (1997) and the publication entitled "PCR Methods and Applications" (1991, Cold Spring Harbor Laboratory Press). In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites. PCR has further been described in several patents including U.S. Pat. Nos. 4,683, 195, 4,683,202 and 4,965,188.

The identification of biallelic markers as described above allows the design of appropriate oligonucleotides, which can be used as primers to amplify DNA fragments comprising the biallelic markers of the present invention. Amplification can be performed using the primers initially used to discover new biallelic markers which are described herein or any set of primers allowing the amplification of a DNA fragment comprising a biallelic marker of the present invention. Primers can be prepared by any suitable method. As for example, direct chemical synthesis by a method such as the phosphodiester method of Narang S. A. et al. (*Methods Enzymol.* 68:90–98, 1979), the phosphodiester method of Brown E. L. et al. (*Methods Enzymol.* 68:109–151, 1979), the diethylphosphoramidite method of Beaucage et al. (*Tetrahedron Lett.* 22:1859–1862, 1981) and the solid support method described in EP 0 707 592.

In some embodiments the present invention provides primers for amplifying a DNA fragment containing one or more biallelic markers of the present invention. It will be appreciated that the amplification primers listed in the present specification are merely exemplary and that any other set of primers which produce amplification products containing one or more biallelic markers of the present invention.

The primers are selected to be substantially complementary to the different strands of each specific sequence to be amplified. The length of the primers of the present invention can range from 8 to 100 nucleotides, preferably from 8 to 50, 8 to 30 or more preferably 8 to 25 nucleotides. Shorter primers tend to lack specificity for a target nucleic acid sequence and generally require cooler temperatures to form sufficiently stable hybrid complexes with the template. Longer primers are expensive to produce and can sometimes self-hybridize to form hairpin structures. The formation of stable hybrids depends on the melting temperature™ of the DNA. The Tm depends on the length of the primer, the ionic strength of the solution and the G+C content. The higher the G+C content of the primer, the higher is the melting temperature because G:C pairs are held by three H bonds whereas A:T pairs have only two. The G+C content of the amplification primers of the present invention preferably ranges between 10 and 75%, more preferably between 35 and 60%, and most preferably between 40 and 55%. The appropriate length for primers under a particular set of assay conditions is empirically determined by one of skill in the art.

The spacing of the primers determines the length of the segment to be amplified. In the context of the present invention amplified segments carrying biallelic markers can range in size from at least about 25 bp to 35 kbp. Amplification fragments from 25–3000 bp are typical, fragments from 50–1000 bp are preferred and fragments from 100–600 bp are highly preferred. It will be appreciated that amplification primers for the biallelic markers is any sequence which allow the specific amplification of any DNA fragment carrying the markers. Amplification primers is labeled or immobilized on a solid support as described in Section II.

X.C. Methods of Genotyping DNA Samples for Biallelic Markers

Any method known in the art can be used to identify the nucleotide present at a biallelic marker site. Since the biallelic marker allele to be detected has been identified and specified in the present invention, detection will prove routine for one of ordinary skill in the art by employing any of a number of techniques. Many genotyping methods require the previous amplification of the DNA region carrying the biallelic marker of interest. While the amplification of target or signal is often preferred at present, ultrasensitive detection methods which do not require amplification are also encompassed by the present genotyping methods. Methods well-known to those skilled in the art that can be used to detect biallelic polymorphisms include methods such as, conventional dot blot analyzes, single strand conformational polymorphism analysis (SSCP) described by Orita et al. (*Proc. Natl. Acad. Sci. U.S.A* 86:27776–2770, 1989), denaturing gradient gel electrophoresis (DGGE), heteroduplex analysis, mismatch cleavage detection, and other conventional techniques as described in Sheffield, V. C. et al. (*Proc. Natl. Acad. Sci. USA* 49:699–706, 1991), White et al. (*Genomics* 12:301–306, 1992), Grompe, M. et al. (*Proc. Natl. Acad. Sci. USA* 86:5855–5892, 1989) and Grompe, M. (*Nature Genetics* 5:111–17, 1993). Another method for determining the identity of the nucleotide present at a particular polymorphic site employs a specialized exonuclease-resistant nucleotide derivative as described in U.S. Pat. No. 4,656,127.

Preferred methods involve directly determining the identity of the nucleotide present at a biallelic marker site by sequencing assay, allele-specific amplification assay, or hybridization assay. The following is a description of some preferred methods. A highly preferred method is the microsequencing technique. The term "sequencing assay" is used herein to refer to polymerase extension of duplex primer/template complexes and includes both traditional sequencing and microsequencing.

1) Sequencing Assays

The nucleotide present at a polymorphic site can be determined by sequencing methods. In a preferred embodiment, DNA samples are subjected to PCR amplification before sequencing as described above. Methods for sequencing DNA using either the dideoxy-mediated method (Sanger method) or the Maxam-Gilbert method are widely known to those of ordinary skill in the art. Such methods are for example disclosed in Maniatis et al. (Molecular Cloning, A Laboratory Manual, Cold Spring Harbor Press, Second Edition, 1989). Alternative approaches include hybridization to high-density DNA probe arrays as described in Chee et al. (Science 274, 610, 1996).

Preferably, the amplified DNA is subjected to automated dideoxy terminator sequencing reactions using a dye-primer cycle sequencing protocol. The products of the sequencing reactions are run on sequencing gels and the sequences are determined using gel image analysis.

The polymorphism detection in a pooled sample is based on the presence of superimposed peaks in the electrophoresis pattern resulting from different bases occurring at the same position. Because each dideoxy terminator is labeled with a different fluorescent molecule, the two peaks corresponding to a biallelic site present distinct colors corresponding to two different nucleotides at the same position on the sequence. However, the presence of two peaks can be an artifact due to background noise. To exclude such an artifact, the two DNA strands are sequenced and a comparison between the peaks is carried out. In order to be registered as a polymorphic sequence, the polymorphism has to be detected on both strands.

The above procedure permits those amplification products, which contain biallelic markers to be identified. The detection limit for the frequency of biallelic polymorphisms detected by sequencing pools of 100 individuals is approximately 0.1 for the minor allele, as verified by sequencing pools of known allelic frequencies.

Microsequencing Assays

In microsequencing methods, the nucleotide at a polymorphic site in a target DNA is detected by a single nucleotide primer extension reaction. This method involves appropriate microsequencing primers which, hybridize just upstream of the polymorphic base of interest in the target nucleic acid. A polymerase is used to specifically extend the 3' end of the primer with one single ddNTP (chain terminator) complementary to the nucleotide at the polymorphic site. Next the identity of the incorporated nucleotide is determined in any suitable way.

Typically, microsequencing reactions are carried out using fluorescent ddNTPs and the extended microsequencing primers are analyzed by electrophoresis on ABI 377 sequencing machines to determine the identity of the incorporated nucleotide as described in EP 412 883. Alternatively capillary electrophoresis can be used in order to process a higher number of assays simultaneously.

Different approaches can be used to detect the nucleotide added to the microsequencing primer. A homogeneous phase detection method based on fluorescence resonance energy transfer has been described by Chen and Kwok (*Nucleic Acids Research* 25:347–353 1997) and Chen et al. (*Proc. Natl. Acad. Sci. USA* 94/20 10756–10761,1997). In this method amplified genomic DNA fragments containing polymorphic sites are incubated with a 5'-fluorescein-labeled primer in the presence of allelic dye-labeled dideoxyribonucleoside triphosphates and a modified Taq polymerase. The dye-labeled primer is extended one base by the dye-terminator specific for the allele present on the template. At the end of the genotyping reaction, the fluorescence intensities of the two dyes in the reaction mixture are analyzed directly without separation or purification. All these steps can be performed in the same tube and the fluorescence changes can be monitored in real time. Alternatively, the extended primer is analyzed by MALDI-TOF Mass Spectrometry. The base at the polymorphic site is identified by the mass added onto the microsequencing primer (see Haff L. A. and Smirnov I. P., *Genome Research,* 7:378–388, 1997).

Microsequencing is achieved by the established microsequencing method or by developments or derivatives thereof. Alternative methods include several solid-phase microsequencing techniques. The basic microsequencing protocol is the same as described previously, except that the method is conducted as a heterogenous phase assay, in which the primer or the target molecule is immobilized or captured onto a solid support. To simplify the primer separation and the terminal nucleotide addition analysis, oligonucleotides are attached to solid supports or are modified in such ways that permit affinity separation as well as polymerase extension. The 5' ends and internal nucleotides of synthetic oligonucleotides can be modified in a number of different ways to permit different affinity separation approaches, e.g., biotinylation. If a single affinity group is used on the oligonucleotides, the oligonucleotides can be separated from the incorporated terminator regent. This eliminates the need of physical or size separation. More than one oligonucleotide can be separated from the terminator reagent and analyzed simultaneously if more than one affinity group is used. This permits the analysis of several nucleic acid species or more nucleic acid sequence information per extension reaction. The affinity group need not be on the priming oligonucleotide but could alternatively be present on the template. For example, immobilization can be carried out via an interaction between biotinylated DNA and streptavidin-coated microtitration wells or avidin-coated polystyrene particles. In the same manner oligonucleotides or templates is attached to a solid support in a high-density format. In such solid phase microsequencing reactions, incorporated ddNTPs can be radiolabeled (Syvänen, *Clinica Chimica Acta* 226:225–236, 1994) or linked to fluorescein (Livak and Hainer, *Human Mutation* 3:379–385,1994). The detection of radiolabeled ddNTPs can be achieved through scintillation-based techniques. The detection of fluorescein-linked ddNTPs can be based on the binding of antifluorescein antibody conjugated with alkaline phosphatase, followed by incubation with a chromogenic substrate (such as p-nitrophenyl phosphate). Other possible reporter-detection pairs include: ddNTP linked to dinitrophenyl (DNP) and anti-DNP alkaline phosphatase conjugate (Harju et al., *Clin. Chem.* 39/11 2282–2287, 1993) or biotinylated ddNTP and horseradish peroxidase-conjugated streptavidin with 0-phenylenediamine as a substrate (WO 92/15712). As yet another alternative solid-phase microsequencing procedure, Nyren et al. (*Analytical Biochemistry* 208:171–175, 1993) described a method relying on the detection of DNA polymerase activity by an enzymatic luminometric inorganic pyrophosphate detection assay (ELIDA).

Pastinen et al. (*Genome research* 7:606–614, 1997) describe a method for multiplex detection of single nucleotide polymorphism in which the solid phase minisequencing principle is applied to an oligonucleotide array format. High-density arrays of DNA probes attached to a solid support (DNA chips) are further described in X.C.5.

In one aspect the present invention provides polynucleotides and methods to genotype one or more biallelic markers of the present invention by performing a microsequencing assay. It will be appreciated that any primer having a 3' end immediately adjacent to the polymorphic nucleotide is used. However, polynucleotides comprising at least 8, 12, 15, 20, 25, or 30 consecutive nucleotides of the sequence immediately adjacent to the biallelic marker and having a 3' terminus immediately upstream of the corresponding biallelic marker are well suited for determining the identity of a nucleotide at biallelic marker site.

Similarly, it will be appreciated that microsequencing analysis is performed for any biallelic marker or any combination of biallelic markers of the present invention.

Mismatch Detection Assays Based on Polymerases and Ligases

In one aspect the present invention provides polynucleotides and methods to determine the allele of one or more biallelic markers of the present invention in a biological sample, by mismatch detection assays based on polymerases and/or ligases. These assays are based on the specificity of polymerases and ligases. Polymerization reactions places particularly stringent requirements on correct base pairing of the 3' end of the amplification primer and the joining of two oligonucleotides hybridized to a target DNA sequence is quite sensitive to mismatches close to the ligation site, especially at the 3' end. Methods, primers and various parameters to amplify DNA fragments comprising biallelic markers of the present invention are further described above in X.B.

Allele Specific Amplification

Discrimination between the two alleles of a biallelic marker can also be achieved by allele specific amplification, a selective strategy, whereby one of the alleles is amplified without amplification of the other allele. This is accomplished by placing the polymorphic base at the 3' end of one of the amplification primers. Because the extension forms from the 3' end of the primer, a mismatch at or near this position has an inhibitory effect on amplification. Therefore, under appropriate amplification conditions, these primers only direct amplification on their complementary allele. Designing the appropriate allele-specific primer and the corresponding assay conditions are well with the ordinary skill in the art.

Ligation/amplification Based Methods

The "Oligonucleotide Ligation Assay" (OLA) uses two oligonucleotides which are designed to be capable of hybridizing to abutting sequences of a single strand of a target molecules. One of the oligonucleotides is biotinylated, and the other is detectably labeled. If the precise complementary sequence is found in a target molecule, the oligonucleotides will hybridize such that their termini abut, and create a ligation substrate that can be captured and detected. OLA is capable of detecting single nucleotide polymorphisms and is advantageously combined with PCR as described by Nickerson D. A. et al. (*Proc. Natl. Acad. Sci. U.S.A.* 87:8923–8927, 1990). In this method, PCR is used to achieve the exponential amplification of target DNA, which is then detected using OLA.

Other methods which are particularly suited for the detection of single nucleotide polymorphism include LCR (ligase chain reaction), Gap LCR (GLCR) which are described above in X.B. As mentioned above LCR uses two pairs of probes to exponentially amplify a specific target. The sequences of each pair of oligonucleotides, is selected to permit the pair to hybridize to abutting sequences of the same strand of the target. Such hybridization forms a substrate for a template-dependant ligase. In accordance with the present invention, LCR can be performed with oligonucleotides having the proximal and distal sequences of the same strand of a biallelic marker site. In one embodiment, either oligonucleotide will be designed to include the biallelic marker site. In such an embodiment, the reaction conditions are selected such that the oligonucleotides can be ligated together only if the target molecule either contains or lacks the specific nucleotide that is complementary to the biallelic marker on the oligonucleotide. In an alternative embodiment, the oligonucleotides will not include the biallelic marker, such that when they hybridize to the target molecule, a "gap" is created as described in WO 90/01069. This gap is then "filled" with complementary dNTPs (as mediated by DNA polymerase), or by an additional pair of oligonucleotides. Thus at the end of each cycle, each single strand has a complement capable of serving as a target during the next cycle and exponential allele-specific amplification of the desired sequence is obtained.

Ligase/Polymerase-mediated Genetic Bit Analysis™ is another method for determining the identity of a nucleotide at a preselected site in a nucleic acid molecule (WO 95/21271). This method involves the incorporation of a nucleoside triphosphate that is complementary to the nucleotide present at the preselected site onto the terminus of a primer molecule, and their subsequent ligation to a second oligonucleotide. The reaction is monitored by detecting a specific label attached to the reaction's solid phase or by detection in solution.

2) Hybridization Assay Methods

A preferred method of determining the identity of the nucleotide present at a biallelic marker site involves nucleic acid hybridization. The hybridization probes, which can be conveniently used in such reactions, preferably include the probes defined herein. Any hybridization assay is used including Southern hybridization, Northern hybridization, dot blot hybridization and solid-phase hybridization (see Sambrook et al., Molecular Cloning—A Laboratory Manual, Second Edition, Cold Spring Harbor Press, N.Y., 1989).

Hybridization refers to the formation of a duplex structure by two single stranded nucleic acids due to complementary base pairing. Hybridization can occur between exactly complementary nucleic acid strands or between nucleic acid strands that contain minor regions of mismatch. Specific probes can be designed that hybridize to one form of a biallelic marker and not to the other and therefore are able to discriminate between different allelic forms. Allele-specific probes are often used in pairs, one member of a pair showing perfect match to a target sequence containing the original allele and the other showing a perfect match to the target sequence containing the alternative allele. Hybridization conditions should be sufficiently stringent that there is a significant difference in hybridization intensity between alleles, and preferably an essentially binary response, whereby a probe hybridizes to only one of the alleles. Stringent, sequence specific hybridization conditions, under which a probe will hybridize only to the exactly complementary target sequence are well known in the art (Sambrook et al., Molecular Cloning—A Laboratory Manual, Second Edition, Cold Spring Harbor Press, N.Y., 1989).

Stringent conditions are sequence dependent and will be different in different circumstances. Generally, stringent conditions are selected to be about 5° C. lower than the thermal melting point™ for the specific sequence at a defined ionic strength and pH. By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65° C., the preferred hybridization temperature, in prehybridization mixture containing 100 µg/ml denatured salmon sperm DNA and 5–20×10$^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of high and intermediate stringency which is used are well known in the art and as cited in Sambrook et al. (Molecular Cloning—A Laboratory Manual, Second Edition, Cold Spring Harbor Press, N.Y., 1989) and Ausubel et al. (Current Protocols in Molecular Biology, Green Publishing Associates and Wiley Interscience, N.Y., 1989).

Although such hybridizations can be performed in solution, it is preferred to employ a solid-phase hybridization assay. The target DNA comprising a biallelic marker of the present invention is amplified prior to the hybridization reaction. The presence of a specific allele in the sample is determined by detecting the presence or the absence of stable hybrid duplexes formed between the probe and the target DNA. The detection of hybrid duplexes can be carried out by a number of methods. Various detection assay formats are well known which utilize detectable labels bound to either the target or the probe to enable detection of the hybrid duplexes. Typically, hybridization duplexes are separated from unhybridized nucleic acids and the labels bound to the duplexes are then detected. Those skilled in the art will recognize that wash steps is employed to wash away excess target DNA or probe. Standard heterogeneous assay formats are suitable for detecting the hybrids using the labels present on the primers and probes.

Two recently developed assays allow hybridization-based allele discrimination with no need for separations or washes (see Landegren U. et al., *Genome Research,* 8:769–776, 1998). The TaqMan assay takes advantage of the 5' nuclease activity of Taq DNA polymerase to digest a DNA probe annealed specifically to the accumulating amplification product. TaqMan probes are labeled with a donor-acceptor dye pair that interacts via fluorescence energy transfer. Cleavage of the TaqMan probe by the advancing polymerase during amplification dissociates the donor dye from the quenching acceptor dye, greatly increasing the donor fluorescence. All reagents necessary to detect two allelic variants can be assembled at the beginning of the reaction and the results are monitored in real time (see Livak et al., *Nature Genetics*, 9:341–342, 1995). In an alternative homogeneous hybridization based procedure, molecular beacons are used for allele discriminations. Molecular beacons are hairpin-shaped oligonucleotide probes that report the presence of specific nucleic acids in homogeneous solutions. When they bind to their targets they undergo a conformational reorganization that restores the fluorescence of an internally quenched fluorophore (Tyagi et al., *Nature Biotechnology*, 16:49–53, 1998).

The polynucleotides provided herein can be used in hybridization assays for the detection of biallelic marker alleles in biological samples. These probes are characterized in that they preferably comprise between 8 and 50 nucleotides, and in that they are sufficiently complementary to a sequence comprising a biallelic marker of the present invention to hybridize thereto and preferably sufficiently specific to be able to discriminate the targeted sequence for only one nucleotide variation. The GC content in the probes of the invention usually ranges between 10 and 75%, preferably between 35 and 60%, and more preferably between 40 and 55%. The length of these probes can range from 10, 15, 20, or 30 to at least 100 nucleotides, preferably from 10 to 50, more preferably from 18 to 35 nucleotides. A particularly preferred probe is 25 nucleotides in length. Preferably the biallelic marker is within 4 nucleotides of the center of the polynucleotide probe. In particularly preferred probes the biallelic marker is at the center of said polynucleotide. Shorter probes may lack specificity for a target nucleic acid sequence and generally require cooler temperatures to form sufficiently stable hybrid complexes with the template. Longer probes are expensive to produce and can sometimes self-hybridize to form hairpin structures. Methods for the synthesis of oligonucleotide probes have been described above and can be applied to the probes of the present invention.

Preferably the probes of the present invention are labeled or immobilized on a solid support. Labels and solid supports are further described in II. Detection probes are generally nucleic acid sequences or uncharged nucleic acid analogs such as, for example peptide nucleic acids which are disclosed in International Patent Application WO 92/20702, morpholino analogs which are described in U.S. Pat. Nos. 5,185,444; 5,034,506 and 5,142,047. The probe may have to be rendered "non-extendable" in that additional dNTPs cannot be added to the probe. In and of themselves analogs usually are non-extendable and nucleic acid probes can be rendered non-extendable by modifying the 3' end of the probe such that the hydroxyl group is no longer capable of participating in elongation. For example, the 3' end of the probe can be functionalized with the capture or detection label to thereby consume or otherwise block the hydroxyl group. Alternatively, the 3' hydroxyl group simply can be cleaved, replaced or modified, U.S. patent application Ser. No. 07/049,061 filed Apr. 19, 1993 describes modifications, which can be used to render a probe non-extendable.

The probes of the present invention are useful for a number of purposes. They can be used in Southern hybridization to genomic DNA or Northern hybridization to mRNA. The probes can also be used to detect PCR amplification products. By assaying the hybridization to an allele specific probe, one can detect the presence or absence of a biallelic marker allele in a given sample.

High-Throughput parallel hybridizations in array format are specifically encompassed within "hybridization assays" and are described below.

Hybridization to Addressable Arrays of Oligonucleotides

Hybridization assays based on oligonucleotide arrays rely on the differences in hybridization stability of short oligonucleotides to perfectly matched and mismatched target sequence variants. Efficient access to polymorphism information is obtained through a basic structure comprising high-density arrays of oligonucleotide probes attached to a solid support (the chip) at selected positions. Each DNA chip can contain thousands to millions of individual synthetic DNA probes arranged in a grid-like pattern and miniaturized to the size of a dime.

The chip technology has already been applied with success in numerous cases. For example, the screening of mutations has been undertaken in the BRCA1 gene, in *S. cerevisiae* mutant strains, and in the protease gene of HIV-1 virus (Hacia et al., *Nature Genetics*, 14(4):441–447, 1996; Shoemaker et al., *Nature Genetics*, 14(4):450–456, 1996; Kozal et al., *Nature Medicine*, 2:753–759, 1996). Chips of various formats for use in detecting biallelic polymorphisms can be produced on a customized basis by Affymetrix (GeneChip™), Hyseq (HyChip and HyGnostics), and Protogene Laboratories.

In general, these methods employ arrays of oligonucleotide probes that are complementary to target nucleic acid sequence segments from an individual which, target sequences include a polymorphic marker. EP785280 describes a tiling strategy for the detection of single nucleotide polymorphisms. Briefly, arrays may generally be "tiled" for a large number of specific polymorphisms. By "tiling" is generally meant the synthesis of a defined set of oligonucleotide probes which is made up of a sequence complementary to the target sequence of interest, as well as preselected variations of that sequence, e.g., substitution of one or more given positions with one or more members of the basis set of monomers, i.e. nucleotides. Tiling strategies are further described in PCT application No. WO 95/11995. In a particular aspect, arrays are tiled for a number of specific, identified biallelic marker sequences. In particular the array is tiled to include a number of detection blocks, each detection block being specific for a specific biallelic marker or a set of biallelic markers. For example, a detection block is tiled to include a number of probes, which span the sequence segment that includes a specific polymorphism. To ensure probes that are complementary to each allele, the probes are synthesized in pairs differing at the biallelic marker. In addition to the probes differing at the polymorphic base, monosubstituted probes are also generally tiled within the detection block. These monosubstituted probes have bases at and up to a certain number of bases in either direction from the polymorphism, substituted with the remaining nucleotides (selected from A, T, G, C and U). Typically the probes in a tiled detection block will include substitutions of the sequence positions up to and including those that are 5 bases away from the biallelic marker. The monosubstituted probes provide internal controls for the tiled array, to distinguish actual hybridization from artefactual cross-hybridization. Upon completion of hybridization with the target sequence and washing of the array, the array is scanned to determine the position on the array to which the target sequence hybridizes. The hybridization data from the scanned array is then analyzed to identify which allele or alleles of the biallelic marker are present in the sample. Hybridization and scanning is carried out as described in PCT application No. WO 92/10092 and WO 95/11995 and U.S. Pat. No. 5,424,186.

5) Integrated Systems

Another technique, which is used to analyze polymorphisms, includes multicomponent integrated systems, which miniaturize and compartmentalize processes such as PCR and capillary electrophoresis reactions in a single functional device. An example of such technique is disclosed in U.S. Pat. No. 5,589,136, which describes the integration of PCR amplification and capillary electrophoresis in chips.

Integrated systems can be envisaged mainly when microfluidic systems are used. These systems comprise a pattern of microchannels designed onto a glass, silicon, quartz, or plastic wafer included on a microchip. The movements of the samples are controlled by electric, electroosmotic or hydrostatic forces applied across different areas of the microchip to create functional microscopic valves and pumps with no moving parts. Varying the voltage controls the liquid flow at intersections between the micro-machined channels and changes the liquid flow rate for pumping across different sections of the microchip.

For genotyping biallelic markers, the microfluidic system may integrate nucleic acid amplification, microsequencing, capillary electrophoresis and a detection method such as laser-induced fluorescence detection.

XI. Methods of Genetic Analysis Using the Biallelic Markers of the Present Invention The methods available for the genetic analysis of complex traits fall into different categories (see Lander and Schork, *Science*, 265, 2037–2048, 1994). In general, the biallelic markers of the present invention find use in any method known in the art to demonstrate a statistically significant correlation between a genotype and a phenotype. The biallelic markers is used in linkage analysis and in allele-sharing methods. Preferably, the biallelic markers of the present invention are used to identify genes associated with detectable traits using association studies, an approach which does not require the use of affected families and which permits the identification of genes associated with complex and sporadic traits.

The genetic analysis using the biallelic markers of the present invention is conducted on any scale. The whole set of biallelic markers of the present invention or any subset of biallelic markers of the present invention is used. In some embodiments, any additional set of genetic markers including a biallelic marker of the present invention is used. As mentioned above, it should be noted that the biallelic markers of the present invention is included in any complete or partial genetic map of the human genome. These different uses are specifically contemplated in the present invention and claims.

XI.A. Linkage Analysis

Until recently, the identification of genes linked with detectable traits has mainly relied on a statistical approach called linkage analysis. Linkage analysis involves proposing a model to explain the inheritance pattern of phenotypes and genotypes observed in a pedigree. Linkage analysis is based upon establishing a correlation between the transmission of genetic markers and that of a specific trait throughout generations within a family. In this approach, all members of a series of affected families are genotyped with a few hundred markers, typically microsatellite markers, which are distributed at an average density of one every 10 Mb. By comparing genotypes in all family members, one can attribute sets of alleles to parental haploid genomes (haplotyping or phase determination). The origin of recombined fragments is then determined in the offspring of all families. Those that co-segregate with the trait are tracked. After pooling data from all families, statistical methods are used to determine the likelihood that the marker and the trait are segregating independently in all families. As a result of the statistical analysis, one or several regions having a high probability of harboring a gene linked to the trait are selected as candidates for further analysis. The result of linkage analysis is considered as significant (i.e. there is a high probability that the region contains a gene involved in a detectable trait) when the chance of independent segregation of the marker and the trait is lower than 1 in 1000 (expressed as a LOD score>3). Generally, the length of the candidate region identified as having a LOD score of greater than 3 using linkage analysis is between 2 and 20 Mb. Once a candidate region is identified as described above, analysis of recombinant individuals using additional markers allows further delineation of the candidate region. Linkage analysis studies have generally relied on the use of a maximum of 5,000 microsatellite markers, thus limiting the maximum theoretical attainable resolution of linkage analysis to about 600 kb on average.

Linkage analysis has been successfully applied to map simple genetic traits that show clear Mendelian inheritance patterns and which have a high penetrance (i.e., the ratio between the number of trait positive carriers of allele $\alpha$ and the total number of $\alpha$ carriers in the population). About 100 pathological trait-causing genes were discovered using linkage analysis over the last 10 years. In most of these cases, the majority of affected individuals had affected relatives and the detectable trait was rare in the general population (frequencies less than 0.1%). In about 10 cases, such as Alzheimer's Disease, breast cancer, and Type II diabetes, the detectable trait was more common but the allele associated with the detectable trait was rare in the affected population. Thus, the alleles associated with these traits were not responsible for the trait in all sporadic cases.

Linkage analysis suffers from a variety of drawbacks. First, linkage analysis is limited by its reliance on the choice of a genetic model suitable for each studied trait. Furthermore, as already mentioned, the resolution attainable using linkage analysis is limited, and complementary studies are required to refine the analysis of the typical 2 Mb to 20 Mb regions initially identified through linkage analysis. In addition, linkage analysis approaches have proven difficult when applied to complex genetic traits, such as those due to the combined action of multiple genes and/or environmental factors. In such cases, too large an effort and cost are needed to recruit the adequate number of affected families required for applying linkage analysis to these situations, as recently discussed by Risch, N. and Merikangas, K. (*Science*, 273: 1516–1517, 1996). Finally, linkage analysis cannot be applied to the study of traits for which no large informative families are available. Typically, this will be the case in any attempt to identify trait-causing alleles involved in sporadic cases, such as alleles associated with positive or negative responses to drug treatment.

XI.B. Allele-sharing Methods

Whereas linkage analysis involves proposing a model to explain the inheritance pattern of phenotypes and genotypes in a pedigree, allele-sharing methods are not based on constructing a model, but rather on rejecting a model (see Lander and Schork, *Science*, 265, 2037–2048, 1994). More specifically, one tries to prove that the inheritance pattern of a chromosomal region is not consistent with random Mendelian segregation by showing that affected relatives inherit identical copies of the region more often than expected by chance. Because allele-sharing methods are nonparametric (that is, assume no model for the inheritance of the trait), they tend to be more useful for the analysis of complex traits than linkage analysis. Affected relatives should show excess allele sharing even in the presence of incomplete penetrance and polygenic inheritance. Allele-Sharing methods involve studying affected relatives in a pedigree to determine how often a particular copy of a chromosomal region is shared identical-by-descent (IBD), that is, is inherited from a common ancestor within the pedigree. The frequency of IBD sharing at a locus can then be compared with random expectation. Affected sib pair analysis is a well-known special case and is the simplest form of this method.

However, as allele-sharing methods analyze affected relatives, they tend to be of limited value in the genetic analysis of drug responses or in the analysis of side effects to treatments. This type of analysis is impractical in such cases due to the lack of availability of familial cases. In fact, the likelihood of having more than one individual in a family being exposed to the same drug at the same time is very low.

XI.C. Association Studies

The present invention comprises methods for identifying one or several genes among a set of candidate genes that are associated with a detectable trait using the biallelic markers of the present invention. In one embodiment the present invention comprises methods to detect an association between a biallelic marker allele or a biallelic marker haplotype and a trait. Further, the invention comprises methods to identify a trait causing allele in linkage disequilibrium with any biallelic marker allele of the present invention.

As described above, alternative approaches can be employed to perform association studies: genome-wide association studies, candidate region association studies and candidate gene association studies. In a preferred embodiment, the biallelic markers of the present invention are used to perform candidate gene association studies. The candidate gene analysis clearly provides a short-cut approach to the identification of genes and gene polymorphisms related to a particular trait when some information concerning the biology of the trait is available. Further, the biallelic markers of the present invention is incorporated in any map of genetic markers of the human genome in order to perform genome-wide association studies. Methods to generate a high-density map of biallelic markers has been described in U.S. Provisional Patent application Ser. No. 60/082,614. The biallelic markers of the present invention may further be incorporated in any map of a specific candidate region of the genome (a specific chromosome or a specific chromosomal region for example).

As mentioned above, association studies is conducted within the general population and are not limited to studies performed on related individuals in affected families. Linkage disequilibrium and association studies are extremely valuable as they permit the analysis of sporadic or multi-factor traits. Moreover, association studies represent a powerful method for fine-scale mapping enabling much finer mapping of trait causing alleles than linkage studies. Studies based on pedigrees often only narrow the location of the trait causing allele. Association studies and Linkage Disequilibrium mapping methods using the biallelic markers of the present invention can therefore be used to refine the location of a trait causing allele in a candidate region identified by Linkage Analysis or by Allele-Sharing methods. Moreover, once a chromosome segment of interest has been identified, the presence of a candidate gene such as a candidate gene of the present invention, in the region of interest can provide a shortcut to the identification of the trait causing allele. Biallelic markers of the present invention can be used to demonstrate that a candidate gene is associated with a trait. Such uses are specifically contemplated in the present invention and claims.

1) Case-control Populations (Inclusion Criteria)

Association studies do not concern familial inheritance and do not involve the analysis of large family pedigrees but compare the prevalence of a particular genetic marker, or a set of markers, in case-control populations. They are case-control studies based on comparison of unrelated case (affected or trait positive) individuals and unrelated control (random or unaffected or trait negative) individuals. The control group is composed of individuals chosen randomly or of unaffected (trait negative) individuals, preferably the control group is composed of unaffected or trait negative individuals. Further, the control group is preferably both ethnically- and age-matched to the case population. In the following "trait positive population", "case population" and "affected population" are used interchangeably.

An important step in the dissection of complex traits using association studies is the choice of case-control populations (see Lander and Schork, *Science,* 265, 2037–2048, 1994). Narrowing the definition of the disease and restricting the patient population to extreme phenotypes allows one to work with a trait that is more nearly Mendelian in its inheritance pattern and more likely to be homogeneous (patients suffer from the disease for the same genetic reasons). Therefore, a major step in the choice of case-control populations is the clinical definition of a given trait or phenotype. Four criteria are often useful: clinical phenotype, age at onset, family history and severity. Preferably, in order to perform efficient and significant association studies, such as those described herein, the trait under study should preferably follow a bimodal distribution in the population under study, presenting two clear non-overlapping phenotypes (trait positive and trait negative). Nevertheless, even in the absence of such bimodal distribution (as may in fact be the case for more complex genetic traits), any genetic trait may still be analyzed by the association method proposed here by carefully selecting the individuals to be included in the trait positive and trait negative phenotypic groups. The selection procedure involves selecting individuals at opposite ends of the non-bimodal phenotype spectra of the trait under study, so as to include in these trait positive and trait negative populations individuals which clearly represent extreme, preferably non-overlapping phenotypes. This is particularly useful for continuous or quantitative traits (such as blood pressure for example). Selection of individuals at extreme ends of the trait distribution increases the ability to analyze these complex traits. The definition of the inclusion criteria for the case-control populations is an important aspect of association studies. The selection of those drastically different but relatively uniform phenotypes enables efficient comparisons in association studies and the possible detection of marked differences at the genetic level, provided that the sample sizes of the populations under study are significant enough.

Preferably, case-control populations to be included in association studies such as those proposed in the present invention consist of phenotypically homogeneous populations of individuals each representing 100% of the corresponding phenotype if the trait distribution is bimodal. If the trait distribution is non-bimodal, trait positive and trait negative populations consist of phenotypically uniform populations of individuals representing each between 1 and 98%, preferably between 1 and 80%, more preferably between 1 and 50%, and more preferably between 1 and 30%, most preferably between 1 and 20% of the total population under study, and selected among individuals exhibiting non-overlapping phenotypes. In some embodiments, the trait positive and trait negative groups consist of individuals exhibiting the extreme phenotypes within the studied population. The clearer the difference between the two trait phenotypes, the greater the probability of detecting an association with biallelic markers.

In preferred embodiments, a first group of between 50 and 300 trait positive individuals, preferably about 100 individuals, are recruited according to their phenotypes. A similar number of trait negative individuals are included in such studies.

In the present invention, typical examples of inclusion criteria include a diagnosis of cancer or prostate cancer or the evaluation of the response to anti-cancer or anti-prostate cancer agent or side effects to treatment with anti-cancer or anti-prostate cancer agents.

Suitable examples of association studies using biallelic markers including the biallelic markers of the present invention, are studies involving the following populations:

a case population suffering from a form of cancer and a healthy unaffected control population, or a case population suffering from a form of prostate cancer and a healthy unaffected control population, or a case population treated with anticancer agents suffering from side-effects resulting from the treatment and a control population treated with the same agents showing no side-effects, or a case population treated with anti-prostate cancer agents suffering from side-effects resulting from the treatment and a control population treated with the same agents showing no side-effects, or a case population treated with anti-cancer agents showing a beneficial response and a control population treated with same agents showing no beneficial response, or a case population treated with anti-prostate cancer agents showing a beneficial response and a control population treated with same agents showing no beneficial response.

2) Determining the Frequency of an Allele in Case-control Populations

Allelic frequencies of the biallelic markers in each of the populations can be determined using one of the methods described above under the in Section X. under the heading "Methods for genotyping an individual for biallelic markers", or any genotyping procedure suitable for this intended purpose. The frequency of a biallelic marker allele in a population can be determined by genotyping pooled samples or individual samples. One way to reduce the number of genotypings required is to use pooled samples. A major obstacle in using pooled samples is in terms of accuracy and reproducibility for determining accurate DNA concentrations in setting up the pools. Genotyping individual samples provides higher sensitivity, reproducibility and accuracy and; is the preferred method used in the present invention. Preferably, each individual is genotyped separately and simple gene counting is applied to determine the frequency of an allele of a biallelic marker or of a genotype in a given population.

3) Determining the Frequency of a Haplotype in Case-control Populations

The gametic phase of haplotypes is usually unknown when diploid individuals are heterozygous at more than one locus. Different strategies for inferring haplotypes is used to partially overcome this difficulty (see Excoffier L. and Slatkin M., Mol. Biol. Evol., 12(5):921–927, 1995). One possibility is that the multiple-site heterozygous diploids can be eliminated from the analysis, keeping only the homozygotes and the single-site heterozygote individuals, but this approach might lead to a possible bias in the sample composition and the underestimation of low-frequency haplotypes. Another possibility is that single chromosomes can be studied independently, for example, by asymmetric PCR amplification (see Newton et al., Nucleic Acids Res., 17:2503–2516, 1989; Wu et al., Proc. Natl. Acad. Sci. USA, 86:2757, 1989) or by isolation of single chromosome by limit dilution followed by PCR amplification (see Ruano et al., Proc. Natl Acad. Sci. USA, 87:6296–6300, 1990). Further, multiple haplotypes can sometimes be inferred using genealogical information in families (Perlin et al., Am. J. Hum. Genet., 55:777–787, 1994). A sample is haplotyped for sufficiently close biallelic markers by double PCR amplification of specific alleles (Sarkar, G. and Sommer S. S., Biotechniques, 1991). These approaches are not entirely satisfying either because of their technical complexity, the additional cost they entail, their lack of generalization at a large scale, or the possible biases they introduce. To overcome these difficulties, an algorithm based on Hardy-Weinberg equilibrium (random mating) to infer the phase of PCR-amplified DNA genotypes introduced by Clark A. G. (Mol. Biol. Evol., 7:111–122, 1990) is used. Briefly, the principle is to start filling a preliminary list of haplotypes present in the sample by examining unambiguous individuals, that is, the complete homozygotes and the single-site heterozygotes. Then other individuals in the same sample are screened for the possible occurrence of previously recognized haplotypes. For each positive identification, the complementary haplotype is added to the list of recognized haplotypes, until the phase information for all individuals is either resolved or identified as unresolved. This method assigns a single haplotype to each multiheterozygous individual, whereas several haplotypes are possible when there are more than one heterozygous site. Any other method known in the art to determine the frequency of a haplotype in a population is used. Preferably, an expectation-maximization (EM) algorithm (Dempster et al., J. R. Stat. Soc., 39B:1–38, 1977) leading to maximum-likelihood estimates of haplotype frequencies under the assumption of Hardy-Weinberg proportions is used (see Excoffier L. and Slatkin M., Mol. Biol. Evol., 12(5): 921–927, 1995). The EM algorithm is used to estimate haplotype frequencies in the case when only genotype data from unrelated individuals are available. The EM algorithm is a generalized iterative maximum-likelihood approach to estimation that is useful when data are ambiguous and/or incomplete. The EM algorithm is used to resolve heterozygotes into haplotypes. Haplotype estimations are further described below under the heading "Statistical methods".

4) Genetic Analysis Based on Linkage Disequilibrium

Linkage disequilibrium is the non-random association of alleles at two or more loci and represents a powerful tool for genetic mapping of complex traits (see Jorde L. B., Am. J. Hum. Genet., 56:11–14, 1995). Biallelic markers, because they are densely spaced in the human genome and can be genotyped in large numbers, are particularly useful in genetic analysis based on linkage disequilibrium.

When a disease mutation is first introduced into a population (by a new mutation or the immigration of a mutation carrier), it necessarily resides on a single chromosome and thus on a single "background" or "ancestral" haplotype of linked markers. Consequently, there is complete disequilibrium between these markers and the disease mutation: one finds the disease mutation only in the presence of a specific set of marker alleles. Through subsequent generations recombinations occur between the disease mutation and these marker polymorphisms, and the disequilibrium gradually dissipates. The pace of this dissipation is a function of the recombination frequency, so the markers closest to the disease gene will manifest higher levels of disequilibrium than those that are further away. When not broken up by recombination, "ancestral" haplotypes and linkage disequilibrium between marker alleles at different loci can be tracked not only through pedigrees but also through populations.

The pattern or curve of disequilibrium between disease and marker loci will exhibit a single maximum that occurs at the disease locus. Consequently, the amount of linkage disequilibrium between a disease allele and closely linked genetic markers may yield valuable information regarding the location of the disease gene. For fine-scale mapping of a disease locus, it is useful to have some knowledge of the patterns of linkage disequilibrium that exist between markers in the studied region. As mentioned above the mapping resolution achieved through the analysis of linkage disequilibrium is much higher than that of linkage studies. The high density of biallelic markers combined with linkage disequilibrium analysis provide powerful tools for fine-scale mapping. Different methods to calculate linkage disequilibrium are described below under the heading "Statistical Methods". Moreover, association studies as a method of mapping genetic traits rely on the phenomenon of linkage disequilibrium.

3) Association Studies

As mentioned above, the occurrence of pairs of specific alleles at different loci on the same chromosome is not random, and the deviation from random is called linkage disequilibrium. If a specific allele in a given gene is directly involved in causing a particular trait, its frequency will be statistically increased in an affected (trait positive) population when compared to the frequency in a trait negative population or in a random control population. As a consequence of the existence of linkage disequilibrium, the frequency of all other alleles present in the haplotype carrying the trait-causing allele will also be increased in trait positive individuals compared to trait negative individuals or random controls. Therefore, association between the trait and any allele (specifically a biallelic marker allele) in linkage disequilibrium with the trait-causing allele will suffice to suggest the presence of a trait-related gene in that particular allele's region. Association studies focus on population frequencies. Case-control populations can be genotyped for biallelic markers to identify associations that narrowly locate a trait causing allele. Moreover, any marker in linkage disequilibrium with one given marker associated with a trait will be associated with the trait. Linkage disequilibrium allows the relative frequencies in case-control populations of a limited number of genetic polymorphisms (specifically biallelic markers) to be analyzed as an alternative to screening all possible functional polymorphisms in order to find trait-causing alleles. Association studies compare the frequency of marker alleles in unrelated case-control populations, and represent powerful tools for the dissection of complex traits.

Association Analysis

The general strategy to perform association studies using biallelic markers derived from a candidate gene is to scan two groups of individuals (case-control populations) in order to measure and statistically compare the allele frequencies of the biallelic markers of the present invention in both groups.

If a statistically significant association with a trait is identified for at least one or more of the analyzed biallelic markers, one can assume that: either the associated allele is directly responsible for causing the trait (the associated allele is the trait causing allele), or more likely the associated allele is in linkage disequilibrium with the trait causing allele. The specific characteristics of the associated allele with respect to the candidate gene function usually gives further insight into the relationship between the associated allele and the trait (causal or in linkage disequilibrium). If the evidence indicates that the associated allele within the candidate gene is most probably not the trait causing allele but is in linkage disequilibrium with the real trait causing allele, then the trait causing allele can be found by sequencing the vicinity of the associated marker.

Association studies are usually run in two successive steps. In a first phase, the frequencies of a reduced number of biallelic markers from one or several candidate genes are determined in the trait positive and trait negative populations. In a second phase of the analysis, the identity of the candidate gene and the position of the genetic loci responsible for the given trait is further refined using a higher density of markers from the relevant gene. However, if the candidate gene under study is relatively small in length, as it is the case for many of the candidate genes analyzed included in the present invention, a single phase is sufficient to establish significant associations.

Haplotype Analysis

As described above, when a chromosome carrying a disease allele first appears in a population as a result of either mutation or migration, the mutant allele necessarily resides on a chromosome having a unique set of linked markers: the ancestral haplotype. This haplotype can be tracked through populations and its statistical association with a given trait can be analyzed. The statistical power of association studies is increased by complementing single point (allelic) association studies with multi-point association studies also called haplotype studies. Thus, a haplotype association study allows one to define the frequency and the type of the ancestral carrier haplotype. A haplotype analysis is important in that it increases the statistical significance of an analysis involving individual markers. Indeed, by performing an association study with a set of biallelic markers, it increases the value of the results obtained through the study, allowing false positive and/or negative data that may result from the single marker studies to be eliminated.

In a first stage of a haplotype frequency analysis, the frequency of the possible haplotypes based on various combinations of the identified biallelic markers of the invention is determined. The haplotype frequency is then compared for distinct populations of trait positive and control individuals. The number of trait positive individuals which should be subjected to this analysis to obtain statistically significant results usually ranges between 30 and 300, with a preferred number of individuals ranging between 50 and 150. The same considerations apply to the number of random control or unaffected individuals used in the study. The results of this first analysis provide haplotype frequencies in case-control populations, the relative risk for an individual carrying a given haplotype of being affected with the given trait under study and the estimated p value for each evaluated haplotype.

Interaction Analysis

The biallelic markers of the present invention may also be used to identify patterns of biallelic markers associated with detectable traits resulting from polygenic interactions. The analysis of genetic interaction between alleles at unlinked loci requires individual genotyping using the techniques described herein. The analysis of allelic interaction among a selected set of biallelic markers with appropriate level of statistical significance can be considered as a haplotype analysis, similar to those described in further details within the present invention. Preferably, genotyping typing is performed using the microsequencing technique.

Methods to test for association between a trait and a biallelic marker allele or a haplotype of biallelic marker alleles are described below.

XI.D. Statistical Methods

In general, any method known in the art to test whether a trait and a genotype show a statistically significant correlation is used.

Methods to Estimate Haplotype Frequencies in a Population

As described above, when genotypes are scored, it is often not possible to distinguish heterozygotes so that haplotype frequencies cannot be easily inferred. When the gametic phase is not known, haplotype frequencies can be estimated from the multilocus genotypic data. Any method known to person skilled in the art can be used to estimate haplotype frequencies (see Lange K., *Mathematical and Statistical Methods for Genetic Analysis,* Springer, N.Y., 1997; Weir, B. S., *Genetic data Analysis II: Methods for Discrete population genetic Data,* Sinauer Assoc., Inc., Sunderland, Mass., USA, 1996) Preferably, maximum-likelihood haplotype frequencies are computed using an Expectation- Maximization (EM) algorithm (see Dempster et al., *J. R. Stat. Soc.,* 39B:1–38, 1977; Excoffier L. and Slatkin M., *Mol. Biol. Evol.,* 12(5): 921–927, 1995). This procedure is an iterative process aiming at obtaining maximum-likelihood estimates of haplotype frequencies from multi-locus genotype data when the gametic phase is unknown. Haplotype estimations are usually performed by applying the EM algorithm using for example the EM-HAPLO program (Hawley M. E. et al., *Am. J. Phys. Anthropol.,* 18:104, 1994) or the Arlequin program (Schneider et al., *Arlequin: a software for population genetics data analysis,* University of Geneva, 1997). The EM algorithm is a generalized iterative maximum likelihood approach to estimation and is briefly described below.

In the following part of this text, phenotypes will refer to multi-locus genotypes with unknown phase. Genotypes will refer to known-phase multi-locus genotypes.

Suppose a sample of N unrelated individuals typed for K markers. The data observed are the unknown-phase K-locus phenotypes that can categorized in F different phenotypes. Suppose that we have H underlying possible haplotypes (in case of K biallelic markers, $H=2^K$). For phenotype j, suppose that cj genotypes are possible. We thus have the following equation $$P_j \sum_{i=1}^{c_j} pr(genotype_i) = \sum_{i=1}^{c_j} pr(h_k, h_l) \quad \text{Equation 1}$$

where Pj is the probability of the phenotype j, hk and hl are the two haplotypes constituent the genotype i. Under the Hardy-Weinberg equilibrium, pr(hk,hl) becomes:

$$pr(h_k, h_l) = pr(h_k)^2 \text{ if } h_k = h_l, \; pr(h_k, h_l) = 2pr(h_k) \cdot pr(h_l) \text{ if } h_k \neq h_l. \quad \text{Equation 2}$$

The successive steps of the E-M algorithm can be described as follows: Starting with initial values of the of haplotypes frequencies, noted, $p_1^{(0)}, p_2^{(0)}, \ldots p_T^{(0)}$. these initial values serve to estimate the genotype frequencies (Expectation step) and then estimate another set of haplotype frequencies (Maximization step): $p_1^{(1)}, p_2^{(1)}, \ldots p_T^{(1)}$. these two steps are iterated until change in the sets of haplotypes frequency are very small.

A stop criterion can be that the maximum difference between haplotype frequencies between two iterations is less than $10^{-7}$. These values can be adjusted according to the desired precision of estimations.

In detail, at a given iteration s, the Expectation step consists in calculating the genotypes frequencies by the following equation:

$$pr(genotype_i)^{(s)} = pr(phenotype_j) \cdot \quad \text{Equation 3}$$

$$pr(genotype_i | phenotype_j)^{(s)}$$

$$= \frac{n_j}{N} \cdot \frac{pr(h_k, h_l)^{(s)}}{p_j^{(s)}}$$

where genotype i occurs in phenotype j, and where hk and hl constitute genotype i. Each probability are derived according to equations 1 and 2 above.

Then the Maximization step simply estimates another set of haplotype frequencies given the genotypes frequencies. This approach is also known as gene-counting method (Smith, *Ann. Hum. Genet.,* 21:254–276, 1957).

$$p_t^{(s+1)} = \frac{1}{2} \sum_{j=1}^{F} \sum_{i=1}^{c_j} \delta_{it} \cdot pr(genotype_i)^{(s)} \quad \text{Equation 4}$$

where $\delta_{it}$ is an indicator variable which count the number of time haplotype t in genotype i. It takes the values of 0, 1 or 2.

To ensure that the estimation finally obtained are the maximum-likelihood estimations several values of departures are required. The estimations obtained are compared and if they differ the estimations leading to the best likelihood are kept. The term "haplotype determination method" is used to refer to all methods for determining haplotypes known in the art including expectation-maximization algorithms.

Methods to Calculate Linkage Disequilibrium Between Markers

A number of methods can be used to calculate linkage disequilibrium between any two genetic positions, in practice, linkage disequilibrium is measured by applying a statistical association test to haplotype data taken from a population.

Linkage disequilibrium between any pair of biallelic markers comprising at least one of the biallelic markers of the present invention ($M_i, M_j$) can be calculated for every allele combination ($M_{i1},M_{j1}$; $M_{i1},M_{j2}$; $M_{i2},M_{j1}$ and $M_{i2},M_{j2}$), according to the Piazza formula:

$$\Delta M_{ik},M_{j1}=\sqrt{\theta 4}-\sqrt{(\theta 4+\theta 3)(\theta 4+\theta 2)}, \text{ where:}$$

θ4=−−=frequency of genotypes not having allele k at $M_i$ and not having allele l at $M_j$ θ3=−+=frequency of genotypes not having allele k at $M_i$ and having allele l at $M_j$ θ2=+−=frequency of genotypes having allele k at $M_i$ and not having allele l at $M_j$ Linkage disequilibrium (LD) between pairs of biallelic markers (Mi, Mj) can also be calculated for every allele combination ($M_{i1},M_{j1}$; $M_{i1},M_{j2}$; $M_{i2},M_{j1}$ and $M_{i2},M_{j2}$), according to the maximum-likelihood estimate (MLE) for delta (the composite linkage disequilibrium coefficient), as described by Weir (B. S. Weir, *Genetic Data Analysis*, Sinauer Ass. Eds, 1996). This formula allows linkage disequilibrium between alleles to be estimated when only genotype, and not haplotype, data are available. This LD composite test makes no assumption for random mating in the sampled population, and thus seems to be more appropriate than other LD tests for genotypic data.

Another means of calculating the linkage disequilibrium between markers is as follows. For a couple of biallelic markers, Mi ($a_i/b_i$) and Mj ($a_j/b_j$), fitting the Hardy-Weinberg equilibrium, one can estimate the four possible haplotype frequencies in a given population according to the approach described above.

The estimation of gametic disequilibrium between ai and aj is simply:

$$D_{aiaj}=pr(\text{haplotype}(a_i,a_j))-pr(a_i).pr(a_j).$$

Where pr(ai) is the probability of allele ai and aj is the probability of allele aj. and where pr(haplotype (ai, aj)) is estimated as in Equation 3 above.

For a couple of biallelic marker only one measure of disequilibrium is necessary to describe the association between Mi and Mj.

Then a normalized value of the above is calculated as follows:

$$D'aiaj=Daiaj/\max(pr(ai).pr(aj),pr(bi).(bj)) \text{ with } Daiaj<0$$

$$D'aiaj=Daiaj/\max(pr(bi).pr(aj),pr(ai).(bj)) \text{ with } Daiaj>0$$

The skilled person will readily appreciate that other LD calculation methods can be used without undue experimentation.

Linkage disequilibrium among a set of biallelic markers having an adequate heterozygosity rate can be determined by genotyping between 50 and 1000 unrelated individuals, preferably between 75 and 200, more preferably around 100.

Testing for Association

Methods for determining the statistical significance of a correlation between a phenotype and a genotype, in this case an allele at a biallelic marker or a haplotype made up of such alleles, is determined by any statistical test known in the art and with any accepted threshold of statistical significance being required. The application of particular methods and thresholds of significance are well with in the skill of the ordinary practitioner of the art.

Testing for association is performed by determining the frequency of a biallelic marker allele in case and control populations and comparing these frequencies with a statistical test to determine if their is a statistically significant difference in frequency which would indicate a correlation between the trait and the biallelic marker allele under study. Similarly, a haplotype analysis is performed by estimating the frequencies of all possible haplotypes for a given set of biallelic markers in case and control populations, and comparing these frequencies with a statistical test to determine if their is a statistically significant correlation between the haplotype and the phenotype (trait) under study. Any statistical tool useful to test for a statistically significant association between a genotype and a phenotype is used. Preferably the statistical test employed is a chi square test with one degree of freedom. A P-value is calculated (the P-value is the probability that a statistic as large or larger than the observed one would occur by chance).

Statistical Significance

In preferred embodiments, significance for diagnosis purposes, either as a positive basis for further diagnostic tests or as a preliminary starting point for early preventive therapy, the p value related to a biallelic marker association is preferably about $1 \times 10^{-2}$ or less, more preferably about $1 \times 10^{-4}$ or less, for a single biallelic marker analysis and about $1 \times 10^{-3}$ or less, still more preferably $1 \times 10^{-6}$ or less and most preferably of about $1 \times 10^{-8}$ or less, for a haplotype analysis involving several markers. These values are believed to be applicable to any association studies involving single or multiple marker combinations.

The skilled person can use the range of values set forth above as a starting point in order to carry out association studies with biallelic markers of the present invention. In doing so, significant associations between the biallelic markers of the present invention and cancer and prostate cancer can be revealed and used for diagnosis and drug screening purposes.

Using the method described above and evaluating the associations for single marker alleles or for haplotypes permits an estimation of the risk a corresponding carrier has to develop a given trait, and particularly in the context of the present invention, a disease, preferably cancer, more preferably prostate cancer. Significance thresholds of relative risks are to be adapted to the reference sample population used.

In this regard, among all the possible marker combinations or haplotypes which are evaluated to determine the significance of their association with a given trait, for example a form of cancer or prostate cancer, a response to treatment with anti-cancer or anti-prostate cancer agents or side effects related to treatment with anti-cancer or anti-prostate cancer agents, it is believed that those displaying a coefficient of relative risk above 1, preferably about 5 or more, preferably of about 7 or more are indicative of a "significant risk" for the individuals carrying the identified haplotype to develop the given trait. It is difficult to evaluate accurately quantified boundaries for the so-called "significant risk". Indeed, and as it has been demonstrated previously, several traits observed in a given population are multifactorial in that they are not only the result of a single genetic predisposition but also of other factors such as environmental factors or the presence of further, apparently unrelated, haplotype associations. Thus, the evaluation of a significant risk must take these parameters into consideration in order to, in a certain manner, weigh the potential importance of external parameters in the development of a given trait. Without wishing to be bound to any invariable model or theory based on the above statistical analyses, the inventors believe that a "significant risk" to develop a given trait is evaluated differently depending on the trait under consideration.

It will of course be understood by practitioners skilled in the treatment or diagnosis of cancer and prostate cancer that the present invention does not intend to provide an absolute identification of individuals who could be at risk of developing a particular form of cancer or who will or will not respond or exhibit side effects to treatment with anti-cancer or anti-prostate cancer agents but rather to indicate a certain degree or likelihood of developing a disease or of observing in a given individual a response or a side effect to treatment with a particular agent or set of agents.

However, this information is extremely valuable as it can, in certain circumstances, be used to initiate preventive treatments or to allow an individual carrying a significant haplotype to foresee warning signs such as minor symptoms. In the case of cancer, the knowledge of a potential predisposition, even if this predisposition is not absolute, might contribute in a very significant manner to treatment, or allow for suggestions in changes in diet or the reduction of risky behaviors, e.g. smoking. Similarly, a diagnosed predisposition to a potential side effect could immediately direct the physician toward a treatment, for which such side effects have not been observed during clinical trials.

Phenotypic Randomization

In order to confirm the statistical significance of the first stage haplotype analysis described above, it might be suitable to perform further analyses in which genotyping data from case-control individuals are pooled and randomized with respect to the trait phenotype. Each individual genotyping data is randomly allocated to two groups which contain the same number of individuals as the case-control populations used to compile the data obtained in the first stage. A second stage haplotype analysis is preferably run on these artificial groups, preferably for the markers included in the haplotype of the first stage analysis showing the highest relative risk coefficient. This experiment is reiterated between 50 and 200 times, preferably between 75 and 125 times. The repeated iterations allow the determination of the percentage of obtained haplotypes with a significant p-value level below about 1×10−3.

EXAMPLE 24

Detailed Association Studies

The initial association studies between the 8p23 locus and prostate cancer described in Section I.D. were repeated at a higher level of sophistication.

Collection of DNA Samples from Affected and Non-affected Individuals

Prostate cancer patients were recruited according to clinical inclusion criteria based on pathological or radical prostatectomy records as described above in Section I. However, the pool of individuals suffering from prostate cancer described in Section I was augmented from the original 185 individuals to a range of between 275 and 491 individuals depending on the marker tested. Similarly, the control pool of non-diseased individuals described in Section I was augmented from the original 104 individuals to a range of between 130 and 313 individuals depending on the marker tested.

Genotyping Affected and Control Individuals

As for Section I.D., allelic frequencies of the biallelic markers in each population were determined by performing microsequencing reactions on amplified fragments obtained by genomic PCR performed on the DNA samples from each individual as described in Example 5.

Association Studies

Association results were obtained using markers spanning a 650 kb region of the 8p28 locus around PG1 both using single point analysis and haplotyping studies. See FIG. 16. As compared with the earlier representation of the initial association results for this region shown in FIG. 2, FIG. 16 is to scale, since the entire region has now been sequenced. In addition, more markers were generated around the association peak in the area of PG1; each of which has been tested in single point analysis (hence the density of data within this subregion). The haplotyping curve in FIG. 16 represents, for each marker considered, the maximum p-value for haplotypes obtained using this marker and any number from all markers harbored by the same BAC and being in Hardy Weindeberg Disequilibrium with said marker.

The data presented in FIG. 16 shows a strong association between this specific region within 8p23 locus, especially in the area that has been identified as being the PG1 gene, and prostate cancer. The maximum p-value in single point analysis, for the PG1 sub-region, is $3.10^{-3}$, while outside of the PG1 subregion, most of the p-values obtained for single point associations are less significant than $1.10^{-1}$. The maximum p-value obtained for haplotyping studies is the one obtained for a marker inside PG1's BAC, and equals $3.10^{-6}$.

FIG. 17 is a graph showing an enlarged view of the single point association results within a 160 kb region comprising the PG1 gene. Markers involved in this enlargement were all located on BAC B0463F01 (see FIG. 16), except marker 4-14, which lies in very close proximity, on BAC B0189E08. FIG. 17 shows all of the markers which made up the maximum haplotype shown in FIG. 16. Some of these markers were later revealed to lie within the promoter, exonic or intronic regions of the PG1 gene. The markers outside the gene were all informative biallelic markers with a least frequent allele present at a frequency of more than 20%, while markers within the gene were a mix of such informative markers and markers whose least frequent allele's frequency is less than 20%. These data confirm and narrow the previous peak of association values seen in FIG. 16, to a 40 kb harboring the PG1 gene. Significant associations are obtained for markers starting at the promoter site with marker No. 99-1485, and ending at the 3' UTR site with marker No. 5-66.

FIG. 18A is a graph showing an enlarged view of the single point association results of 40 kb within the PG1 gene. These data confirm that seven markers within the PG1 gene have one allele associated with prostate cancer, with p-values all similar and more significant than $1.10^{-2}$, specifically markers 99-622; 4-77; 4-71; 4-73; 99-598; 99-576; 4-66. FIG. 18B is a table listing the location of markers within PG1 gene, the two possible alleles at each site. For each marker, the disease-associated allele is indicated first; its frequencies in cases and controls as well as the difference between both are shown; the odd-ratio and the p-value of each individual marker association are also shown.

The data in FIGS. 17, 18A, and 18B demonstrate that the markers in the PG1 gene have an association with prostate cancer that is valid, and exhibits similar significance values, regardless whether the considered cases are sporadic or familial cases. Therefore, some PG1 alleles must be general risk factors for any type of prostate cancer, whether familial or sporadic. The fact that several p-values for associated alleles are around $1.10^{-2}$ suggests that all these markers are in linkage disequilibrium to one another, and can all be used individually to assess PG1 associated prostate cancer susceptibility risk. The prostate cancer associated alleles of the 7 markers discussed above, all exhibit an odd-ratio of about 1.5, which means for each of them that an individual carrying such allele has 1.5 more chances to be susceptible to prostate cancer than not.

In order to confirm the significance of the association results found for markers on the BAC harboring PG1, we a novel statistical method was performed as described in provisional patent application Ser. No. 60/107,986, filed Nov. 10, 1998, the specification of which is incorporated herein.

Haplotype Analysis

The results of a haplotype analysis study using 4 markers (marker Nos. 4-14, 99-217, 4-66 and 99-221)) within the 160 kb region shown in FIG. 17 are shown in FIG. 19A. These 4 markers have each been shown to be strongly associated with prostate cancer, i.e. with p-values more significant than $1.10^{-3}$ on approximately 150 cases and 130 controls. All haplotypes using 2, 3, or 4 markers among the 4 above cited were analyzed using 491 case patients and 317 control individuals. FIG. 19A shows the most significant haplotypes obtained, as well as the individual odd-ratios for each. Haplotype 11 is the most significant (p-value of ca. $3.10^{-6}$), and is related to haplotype 5, shown in FIG. 4 in that three of the four marker alleles (4-14 C, 99-217 T and 99-221 A) are common to both haplotypes, and both cover a similar region. Differences in p-values are explained both by the addition of markers and of more case or control individuals. Haplotype 11 has an highly informative odd-ratio (of above 3); it is present in 3% of the controls and almost 10% of the cases.

FIG. 19B is a table showing the segmented haplotyping results according to the age of the subjects, and whether the prostate cancer cases were sporadic or familial, using the same markers 4 markers and the same individuals as were used to generate the results in FIG. 19A. FIG. 19B shows equivalent results for all segments of the population analyzed, demonstrating that the PG1 associated alleles are general risk factors for prostate cancer, regardless of the age of onset of the disease.

The haplotyping results and odd ratios for all of the combinations of the 7 markers (99-622; 4-77; 4-71; 4-7; 99-598; 99-576; and 4-66) within PG1 gene that were shown in FIG. 18 to have p-values more significant than $1 \times 10^{-2}$ were computed. A portion of these data are shown in FIG. 20. All of the 2-, 3-, 4-, 5-, 6- and 7-marker haplotypes were tested. FIG. 20 identifies for each x-marker haplotype category, the most significant haplotype. Among all these, the most significant haplotype is the two-marker haplotype 1, which shows a p-value of approximately $6.10^{-5}$, with an odd ratio of 2. The frequency of haplotype 1 among the control individuals is 15%, while it is 26% among the case patients. It is worth noting that these frequencies are very similar for all haplotypes presented on FIG. 20. It will thus be sufficient to test this two marker haplotype for prognosis/diagnosis on risk patients, as opposed to having a more complex test of a haplotype comprising 3 or more makers.

Finally, FIG. 21 is a graph showing the distribution of statistical significance, as measured by Chi-square values, for each series of possible x-marker haplotypes, (x=2, 3 or 4) using all of the 19 markers found in PG1 gene. These data confirm that testing 2-marker haplotypes within PG1 is sufficient because the testing 3- or 4-marker haplotypes does not increase the statistical relevance of the analysis.

EXAMPLE 25

Attributable Risk

Attributable risk describes the proportion of individuals in a population exhibiting a phenotype due to exposure to a particular factor. For further discussion of attributable risk values, see Holland, Bart K, *Probability without Equations—Concepts for Clinicians;* The Johns Hopkins University Press, pp. 88–90. In the present case the phenotype examined was prostate cancer, and the exposure was either one single allele of an individual PG1-related marker, or a haplotype thereof in an individual's genome.

The formula used for calculating attributable risk values in the present study was the following:

$AR = P_E(RR-1)/[P_E(RR-1)+1]$, where:

AR was the attributable risk of allele or haplotype;
$P_E$ was the frequency of exposure to allele or haplotype within the population at large, in the present study a random male Caucasian population; and
RR was the relative risk, in the present study relative risk is approximated with the odd-ratio, because of the relatively low incidence of prostate cancer in populations at large (values for the odd ratios are found in FIGS. 18B and 20).

In this case, $P_E$ was estimated using a dominant transmission model for prostate cancer:

$P_E = (N_{AA} + N_{AB})/N$, where:

$N_{AA}$ was the number of homozygous individuals harboring the disease associated allele or haplotype within a given random population, and $N_{AB}$ was the number of heterozygous individuals is said random population. $N_{AA}$ and $N_{AB}$ were calculated using the allele frequencies in the random population as indicated in FIGS. 18B and 20, and N was the number of individuals in total random population.

We calculated the attributable risks of disease-associated alleles for markers within PG1 gene and presented these results in FIG. 18B. In FIG. 20, the attributable risk for the two-marker haplotypes present in the figure as shown as well. These data demonstrate that disease-associated alleles of PG1 are present in approximately 20% of prostate cancer patients in the Caucasian population at large, and therefor represent prognostic tools of significant value.

XII. Computer-related Embodiments

As used herein the term "nucleic acid codes of the invention" encompass the nucleotide sequences comprising, consisting essentially of, or consisting of any one of the following: a) a contiguous span of at least 12, 15, 18, 20, 25, 30, 35, 40, 50, 60, 70, 80, 90, 100, 150, 200, 500, or 1000 nucleotides of SEQ ID No 179, wherein said contiguous span comprises at least 1, 2, 3, 5, 10, or 25 of the following nucleotide positions of SEQ ID No 179: 1–2324, 2852–2936, 3204–3249, 3456–3572, 3899–4996, 5028–6086, 6310–8710, 9136–11170, 11534–12104, 12733–13163, 13206–14150, 14191–14302, 14338–14359, 14788–15589, 16050–16409, 16440–21718, 21959–22007, 22086–23057, 23488–23712, 23832–24099, 24165–24376, 24429–24568, 24607–25096, 25127–25269, 25300–27576, 27612–29217, 29415–30776, 30807–30986, 31628–32658, 32699–36324, 36772–39149, 39184–40269, 40580–40683, 40844–41048, 41271–43539, 43570–47024, 47510–48065, 48192–49692, 49723–50174, 52626–53599, 54516–55209, and 55666–56146; b) a contiguous span of at least 12, 15, 18, 20, 25, 30, 35, 40, 50, 60, 70, 80, 90, 100, 150, 200, 500, or 1000 nucleotides of SEQ ID No 3 or the complements thereof, wherein said contiguous span comprises at least 1, 2, 3, 5, 10, or 25 of the following nucleotide positions of SEQ ID No 3: 1–280, 651–690, 3315–4288, and 5176–5227; and c) a nucleotide sequence complementary to either one of the preceding nucleotide sequences.

The "nucteic acid codes of the invention" further encompass nucleotide sequences homologous to: a) a contiguous span of at least 12, 15, 18, 20, 25, 30, 35, 40, 50, 60, 70, 80, 90, 100, 150, 200, 500, or 1000 nucleotides of SEQ ID No 179, wherein said contiguous span comprises at least 1, 2, 3, 5, 10, or 25 of the following nucleotide positions of SEQ ID No 179: 1–2324, 2852–2936, 3204–3249, 3456–3572, 3899–4996, 5028–6086, 6310–8710, 9136–11170, 11534–12104, 12733–13163, 13206–14150, 14191–14302, 14338–14359, 14788–15589, 16050–16409, 16440–21718, 21959–22007, 22086–23057, 23488–23712, 23832–24099, 24165–24376, 24429–24568, 24607–25096, 25127–25269, 25300–27576, 27612–29217, 29415–30776, 30807–30986, 31628–32658, 32699–36324, 36772–39149, 39184–40269, 40580–40683, 40844–41048, 41271–43539, 43570–47024, 47510–48065, 48192–49692, 49723–50174, 52626–53599, 54516–55209, and 55666–56146; b) a contiguous span of at least 12, 15, 18, 20, 25, 30, 35, 40, 50, 60, 70, 80, 90, 100, 150, 200, 500, or 1000 nucleotides of SEQ ID No 3 or the complements thereof, wherein said contiguous span comprises at least 1, 2, 3, 5, 10, or 25 of the following nucleotide positions of SEQ ID No 3: 1–280, 651–690, 3315–4288, and 5176–5227; and, c) sequences complementary to all of the preceding sequences. Homologous sequences refer to a sequence having at least 99%, 98%, 97%, 96%, 95%, 90%, 85%, 80%, or 75% homology to these contiguous spans. Homology may be determined using any method described herein, including BLAST2N with the default parameters or with any modified parameters. Homologous sequences also may include RNA sequences in which uridines replace the thymines in the nucleic acid codes of the invention. It will be appreciated that the nucleic acid codes of the invention can be represented in the traditional single character format (See the inside back cover of Stryer, Lubert. Biochemistry, $3^{rd}$ edition. W. H Freeman & Co., New York.) or in any other format or code which records the identity of the nucleotides in a sequence.

As used herein the term "polypeptide codes of the invention" encompass the polypeptide sequences comprising a contiguous span of at least 6, 8, 10, 12, 15, 20, 25, 30, 40, 50, or 100 amino acids of SEQ ID No 4, wherein said contiguous span includes at least 1, 2, 3, or 5 of the amino acid positions 1–26, 295–302, and 333–353. It will be appreciated that the polypeptide codes of the invention can be represented in the traditional single character format or three letter format (See the inside back cover of Stryer, Lubert. Biochemistry, $3^{rd}$ edition. W. H Freeman & Co., New York.) or in any other format or code which records the identity of the polypeptides in a sequence.

It will be appreciated by those skilled in the art that the nucleic acid codes of the invention and polypeptide codes of the invention can be stored, recorded, and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid codes of the invention, or one or more of the polypeptide codes of the invention. Another aspect of the present invention is a computer readable medium having recorded thereon at least 2, 5, 10, 15, 20, 25, 30, or 50 nucleic acid codes of the invention. Another aspect of the present invention is a computer readable medium having recorded thereon at least 2, 5, 10, 15, 20, 25, 30, or 50 polypeptide codes of the invention.

Computer readable media include magnetically readable media, optically readable media, electronically readable media and magnetic/optical media. For example, the computer readable media may be a hard disk a floppy disk, a magnetic tape, CD-ROM, Digital Versatile Disk (DVD), Random Access Memory (RAM), or Read Only Memory (ROM) as well as other types of other media known to those skilled in the art.

Embodiments of the present invention include systems, particularly computer systems which store and manipulate the sequence information described herein. One example of a computer system 100 is illustrated in block diagram form in FIG. 22. As used herein, "a computer system" refers to the hardware components, software components, and data storage components used to analyze the nucleotide sequences of the nucleic acid codes of the invention or the amino acid sequences of the polypeptide codes of the invention. In one embodiment, the computer system 100 is a Sun Enterprise 1000 server (Sun Microsystems, Palo Alto, Calif.). The computer system 100 preferably includes a processor for processing, accessing and manipulating the sequence data. The processor 105 can be any well-known type of central processing unit, such as the Pentium III from Intel Corporation, or similar processor from Sun, Motorola, Compaq or International Business Machines.

Preferably, the computer system 100 is a general purpose system that comprises the processor 105 and one or more internal data storage components 110 for storing data, and one or more data retrieving devices for retrieving the data stored on the data storage components. A skilled artisan can readily appreciate that any one of the currently available computer systems are suitable.

In one particular embodiment, the computer system 100 includes a processor 105 connected to a bus which is connected to a main memory 115 (preferably implemented as RAM) and one or more internal data storage devices 110, such as a hard drive and/or other computer readable media having data recorded thereon. In some embodiments, the computer system 100 further includes one or more data retrieving device 118 for reading the data stored on the internal data storage devices 110.

The data retrieving device 118 may represent, for example, a floppy disk drive, a compact disk drive, a magnetic tape drive, etc. In some embodiments, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125a–c in a network or wide area network to provide centralized access to the computer system 100.

Software for accessing and processing the nucleotide sequences of the nucleic acid codes of the invention or the amino acid sequences of the polypeptide codes of the invention (such as search tools, compare tools, and modeling tools etc.) may reside in main memory 115 during execution.

In some embodiments, the computer system 100 may further comprise a sequence comparer for comparing the above-described nucleic acid codes of the invention or the polypeptide codes of the invention stored on a computer readable medium to reference nucleotide or polypeptide sequences stored on a computer readable medium. A "sequence comparer" refers to one or more programs which are implemented on the computer system 100 to compare a nucleotide or polypeptide sequence with other nucleotide or polypeptide sequences and/or compounds including but not limited to peptides, peptidomimetics, and chemicals stored within the data storage means. For example, the sequence comparer may compare the nucleotide sequences of nucleic acid codes of the invention or the amino acid sequences of the polypeptide codes of the invention stored on a computer readable medium to reference sequences stored on a computer readable medium to identify homologies, motifs implicated in biological function, or structural motifs. The various sequence comparer programs identified elsewhere in this patent specification are particularly contemplated for use in this aspect of the invention.

FIG. 23 is a flow diagram illustrating one embodiment of a process 200 for comparing a new nucleotide or protein sequence with a database of sequences in order to determine the homology levels between the new sequence and the sequences in the database. The database of sequences can be a private database stored within the computer system 100, or a public database such as GENBANK, PIR OR SWISPROT that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the present invention is a computer system comprising a processor, a data storage device having stored thereon a nucleic acid code of the invention or a polypeptide code of the invention, a data storage device having retrievably stored thereon reference nucleotide sequences or polypeptide sequences to be compared to the nucleic acid code of the invention or polypeptide code of the invention and a sequence comparer for conducting the comparison. The sequence comparer may indicate a homology level between the sequences compared or identify structural motifs in the nucleic acid code of the invention and polypeptide codes of the invention or it may identify structural motifs in sequences which are compared to these nucleic acid codes and polypeptide codes. In some embodiments, the data storage device may have stored thereon the sequences of at least 2, 5, 10, 15, 20, 25, 30, or 50 of the nucleic acid codes of the invention or polypeptide codes of the invention.

Another aspect of the present invention is a method for determining the level of homology between a nucleic acid code of the invention and a reference nucleotide sequence, comprising the steps of reading the nucleic acid code and the reference nucleotide sequence through the use of a computer program which determines homology levels and determining homology between the nucleic acid code and the reference nucleotide sequence with the computer program. The computer program may be any of a number of computer programs for determining homology levels, including those specifically enumerated herein, including BLAST2N with the default parameters or with any modified parameters. The method may be implemented using the computer systems described above. The method may also be performed by reading 2, 5, 10, 15, 20, 25, 30, or 50 of the above described nucleic acid codes of the invention through the use of the computer program and determining homology between the nucleic acid codes and reference nucleotide sequences.

FIG. 24 is a flow diagram illustrating one embodiment of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it should be in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there aren't any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of the nucleic acid codes of the present invention, to reference nucleotide sequences in order to determine whether the nucleic acid code of the invention differs from a reference nucleic acid sequence at one or more positions. Optionally such a program records the length and identity of inserted, deleted or substituted nucleotides with respect to the sequence of either the reference polynucleotide or the nucleic acid code of the invention. In one embodiment, the computer program may be a program which determines whether the nucleotide sequences of the nucleic acid codes of the invention contain one or more single nucleotide polymorphisms (SNP) with respect to a reference nucleotide sequence. These single nucleotide polymorphisms may each comprise a single base substitution, insertion, or deletion.

Another aspect of the present invention is a method for determining the level of homology between a polypeptide code of the invention and a reference polypeptide sequence, comprising the steps of reading the polypeptide code of the invention and the reference polypeptide sequence through use of a computer program which determines homology levels and determining homology between the polypeptide code and the reference polypeptide sequence using the computer program.

Accordingly, another aspect of the present invention is a method for determining whether a nucleic acid code of the invention differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some embodiments, the computer program is a program which identifies single nucleotide polymorphisms The method may be implemented by the computer systems described above and the method illustrated in FIG. 24. The method may also be performed by reading at least 2, 5, 10, 15, 20, 25, 30, or 50 of the nucleic acid codes of the invention and the reference nucleotide sequences through the use of the computer program and identifying differences between the nucleic acid codes and the reference nucleotide sequences with the computer program.

In other embodiments the computer based system may further comprise an identifier for identifying features within the nucleotide sequences of the nucleic acid codes of the invention or the amino acid sequences of the polypeptide codes of the invention.

An "identifier" refers to one or more programs which identifies certain features within the above-described nucleotide sequences of the nucleic acid codes of the invention or the amino acid sequences of the polypeptide codes of the invention. In one embodiment, the identifier may comprise a program which identifies an open reading frame in the cDNAs codes of the invention.

FIG. 25 is a flow diagram illustrating one embodiment of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group (www.gcg.com).

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence.

It should be noted, that if the feature attribute is not found in the first sequence at the decision state 316, the process 300 moves directly to the decision state 320 in order to determine if any more features exist in the database.

In another embodiment, the identifier may comprise a molecular modeling program which determines the 3-dimensional structure of the polypeptides codes of the invention. In some embodiments, the molecular modeling program identifies target sequences that are most compatible with profiles representing the structural environments of the residues in known three-dimensional protein structures. (See, e.g., Eisenberg et al., U.S. Pat. No. 5,436,850 issued Jul. 25, 1995). In another technique, the known three-dimensional structures of proteins in a given family are superimposed to define the structurally conserved regions in that family. This protein modeling technique also uses the known three-dimensional structure of a homologous protein to approximate the structure of the polypeptide codes of the invention. (See e.g., Srinivasan, et al., U.S. Pat. No. 5,557,535 issued Sep. 17, 1996). Conventional homology modeling techniques have been used routinely to build models of proteases and antibodies. (Sowdhamini et al., Protein Engineering 10:207, 215 (1997)). Comparative approaches can also be used to develop three-dimensional protein models when the protein of interest has poor sequence identity to template proteins. In some cases, proteins fold into similar three-dimensional structures despite having very weak sequence identities. For example, the three-dimensional structures of a number of helical cytokines fold in similar three-dimensional topology in spite of weak sequence homology.

The recent development of threading methods now enables the identification of likely folding patterns in a number of situations where the structural relatedness between target and template(s) is not detectable at the sequence level. Hybrid methods, in which fold recognition is performed using Multiple Sequence Threading (MST), structural equivalencies are deduced from the threading output using a distance geometry program DRAGON to construct a low resolution model, and a full-atom representation is constructed using a molecular modeling package such as QUANTA.

According to this 3-step approach, candidate templates are first identified by using the novel fold recognition algorithm MST, which is capable of performing simultaneous threading of multiple aligned sequences onto one or more 3-D structures. In a second step, the structural equivalencies obtained from the MST output are converted into interresidue distance restraints and fed into the distance geometry program DRAGON, together with auxiliary information obtained from secondary structure predictions. The program combines the restraints in an unbiased manner and rapidly generates a large number of low resolution model confirmations. In a third step, these low resolution model confirmations are converted into full-atom models and subjected to energy minimization using the molecular modeling package QUANTA. (See e.g., Aszódi et al., Proteins:Structure, Function, and Genetics, Supplement 1:38–42 (1997)).

The results of the molecular modeling analysis may then be used in rational drug design techniques to identify agents which modulate the activity of the polypeptide codes of the invention.

Accordingly, another aspect of the present invention is a method of identifying a feature within the nucleic acid codes of the invention or the polypeptide codes of the invention comprising reading the nucleic acid code(s) or the polypeptide code(s) through the use of a computer program which identifies features therein and identifying features within the nucleic acid code(s) or polypeptide code(s) with the computer program. In one embodiment, computer program comprises a computer program which identifies open reading frames. In a further embodiment, the computer program identifies structural motifs in a polypeptide sequence. In another embodiment, the computer program comprises a molecular modeling program. The method may be performed by reading a single sequence or at least 2, 5, 10, 15, 20, 25, 30, or 50 of the nucleic acid codes of the invention or the polypeptide codes of the invention through the use of the computer program and identifying features within the nucleic acid codes or polypeptide codes with the computer program.

The nucleic acid codes of the invention or the polypeptide codes of the invention may be stored and manipulated in a variety of data processor programs in a variety of formats. For example, they may be stored as text in a word processing file, such as MicrosoftWORD or WORDPERFECT or as an ASCII file in a variety of database programs familiar to those of skill in the art, such as DB2, SYBASE, or ORACLE. In addition, many computer programs and databases may be used as sequence comparers, identifiers, or sources of reference nucleotide or polypeptide sequences to be compared to the nucleic acid codes of the invention or the polypeptide codes of the invention. The following list is intended not to limit the invention but to provide guidance to programs and databases which are useful with the nucleic acid codes of the invention or the polypeptide codes of the invention. The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al., 1990, J. Mol. Biol. 215(3):403–410), FASTA (Pearson and Lipman, 1988, Proc. Natl. Acad. Sci. USA 85(8):2444–2448), FASTDB (Brutlag et al. Comp. App. Biosci. 6:237–245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the EMBL/Swissprotein database, the MDL Available Chemicals Directory database, the MDL Drug Data Report data base, the Comprehensive Medicinal Chemistry database, Derwents's World Drug Index database, the BioByteMasterFile database, the Genbank database, and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

Although this invention has been described in terms of certain preferred embodiments, other embodiments which will be apparent to those of ordinary skill in the art in view of the disclosure herein are also within the scope of this invention. Accordingly, the scope of the invention is intended to be defined only by reference to the appended claims. All documents cited herein are incorporated herein by reference in their entirety.

SEQUENCE LISTING (578 sequences)

SEQ ID NO: 1 - DNA, 56516 bp, Homo sapiens
  promoter (1629)..(1870): identification method Proscan
  misc_feature (1998)..(2000): potential start codon
  misc_feature (2001)..(2216): exon 1
  misc_feature (2031)..(2033): ATG
  misc_feature (11694)..(14332): Tyr Phos
  primer_bind (11930)..(11947): upstream amplification primer 4-77 SEQ ID 42
  allele (12057)..(12103): polymorphic fragment 4-77 SEQ ID 24
  primer_bind (12339)..(12358): downstream amplification primer 4-77 SEQ ID 51, complement
  primer_bind (13547)..(13564): upstream amplification primer 4-73 SEQ ID 64
  allele (13657)..(13703): polymorphic fragment 4-73 SEQ ID 58
  primer_bind (13962)..(13981): downstream amplification primer 4-73 SEQ ID 67, complement
  misc_feature (17997)..(18003): n = a, c, g, or t.
  misc_feature (18196)..(18265): exon 2
  misc_feature (19357)..(19357): n = a, c, g, or t.
  misc_feature (23717)..(23832): exon 3
  misc_feature (25571)..(25660): exon 4
  primer_bind (34216)..(34234): upstream amplification primer 99-217 SEQ ID 43
  allele (34469)..(34515): polymorphic fragment 99-217 SEQ ID 25
  primer_bind (34625)..(34645): downstream amplification primer 99-217 SEQ ID 52, complement
  misc_feature (34669)..(34759): exon 5
  misc_feature (39083)..(39093): n = a, c, g, or t.
  misc_feature (40688)..(40846): exon 6
  misc_feature (48070)..(48193): exon 7
  misc_feature (50182)..(54523): exon 8
  primer_bind (51149)..(51168): upstream amplification primer 4-65 SEQ ID 65
  allele (51448)..(51494): polymorphic fragment 4-65 SEQ ID 59
  primer_bind (51482)..(51499): downstream amplification primer 4-65 SEQ ID 68, complement
  primer_bind (51596)..(51613): upstream amplification primer 4-67 SEQ ID 44
  allele (51612)..(51658): polymorphic fragment 4-67 SEQ ID 26
  primer_bind (51996)..(52015): downstream amplification primer 4-67 SEQ ID 53, complement
  polyA_signal (54445)..(54450): AATAAA
gtggatctgtgactgttcgcaggaagagaggagcgggagcaggacagacaataactgatagtcaggagctgggtttggagataaagagggaacaagagaaagttaagttctgtgttttcatggcaaacattgcacaaaagtttacaacttcgtgactaacagtaatctggggtgattcacaacaaatttacacataaacacatatttactgactttatacacagcaatcctaacgtgaacacagaacctgctttatcttttcgcacactgttctagtgtagagatgtctggtctcagttaaagaaagcataaggagcattagttgtgcacactgtccacacccgtgacttttttccaccagtactaaacctagtgcttcttacagtacagggcaatgacagccacagaaagagagaagctccttttactgtgtaatgcttcctgctggccttcaaatacttgttacttgagagatctccattcacctggctttgtccccaaaggtcatcatctaccaatgatgttgttatttgatgttaatcatgtataaagaaagtagctaccatcctggccctgattagaacttcccactgaaataccgtcctgcctaaaggtagcacaggtttccattatggtggtggtggggagggggcgggaatatatatatatatatatatatatatatatatggtaaagcattcggcattcttttaaagtacaactatccttgaaaagggttacatattaaaccatttttaccacagccaaaggggaggagaaagatccaaaagtcctgtggatctgctttaacatcaataaaacagttatccacccttcgtagcttttagtgaaggctacaaaagtatgctttttatggattacacatgtgcacgcaactactttaattactacagaaaaaaacgaggctccttattaaaaaaaaatcagaaacaagtccaacagactctgaggaaatgaagcaagagtgaattctgaaaaggtctaataaacagtatggaaatatccttgtgggattgttcttcagctatgcataaacatgtaattatcatcattactgtgatggggaaaaacacggaccctaattctgaaacaccctggtagcgagagacgggcaggaggggctgctgcgcactcagagcggaggctgaggaggcggcgtccccttgcaaaggactggcagtgagcagatggggacactcgagctgccccgcgacctgggccgagctgcctacaacctgggcccaggtgcctgcaagaattagacctccgataacgttaacacccactttctcactgctctaattgtgtgcatcccggcgcccaggggcttgtgagcagcaggtgcgcgttccaggcagctccagcgacccttaaacctgaccgcgcgcacgtccggcccgagggagcagaacaagaggcacccggaccctcctccggccagcacccaccttcacccagttccgtcagtcgccaccacctcccttcccgcgtccgcagccggcccagctggggagcatgcgcagtggccggagccgggttgcccgcgccacagcaggtagctgtactgcaactgtcggcccaaaccaaccaatcaagagacgtgttattgccgccgaggtggaactatggcaacgggcgaccaatcagaaggcgcgttgttgccgcggagccccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccaggtgagccgcctcccgctcccgggtctcggcgtccacccgagctcccgggggcgcggacctctccgctcccccacagctggcgagggtcacccggccggcccggcggacccagcacggagagcacgtgccgcctccccgccttcctctccgcatgcttcctgccgttctgccgagatcgctctctaggaagctgtggctgcgtcgtcctgaggctacgagtgggacccgccgcccctttccccgcccctcgcctgggtctgatgctgcttagcaaagtgggtgcagatgcacgttttaaataatagggcacgcgtttagcagtttctggcctttggtccaaagaggtggtcatgttggaacagatcggagacgtctacactccgaagtgcgcttttacagtgacctcttgaaacagaagtacaattcggtcttgtgttctttcccctggacaagtgaaagctgggcgaagaaatgaatacatttgttaaccgtagaagcctaactagatacaattcttgccaactttaactgggcttgaatgtgtgggtgatctgttgtctgattactttctttctgttactgtttctctgtagagattggattcgtagattaaacttgagaaacaaaccataaaagtggaaggccctctttaacagtaggtatttgaagtgttataaaaaaaaaaaaggtgaatttttcttttatttctcagtttgaaagaacagctttattcttggttattcctaatgtccacctagtcctcttttacttttcttggtagggttagggtggcatggggaaatgggacggtatcattttgtctttttaactttttttttttccacctacagcagctgtttttaccctgtggtcagtcaggtactatatttagtttgcagttgcactgctgatcgacccttgatggccccagttggaagttgtttggggggaaggaactaggagaggccagggcctccatttaaaccagtgtctgtaagtgtctccttggaaggaaaaaaagatactgttccaggtcatggtttcctggtagttgacgtttaaaatgggcctcatttaaaaatttcaataattcaggctaattttttccctttatatggtaactccaccaagtttgtctaaatgtatgatttttatcatgattaagtttttacttccacatcatgtgacaactggcctgggatgggatataagctcagaacacaaagtcattcacctgttaaaaaaataattctatctgtggcgggttatgttatttttgttcaaagaggacacaatatgatgcagaatacaccattgaaggattttttggtttggcaagttcttatttttttaaatggctgtaaaacctagcagtgtttctgaaattgcataccttacctgatgttcagagatccgatttacttcttgatttcccagcaagtgattttgaaaacatttaatctaatcattccccccaccgtctgttcaaatcaaaggaagtggcatccagcactaattttcatgcatttatgaaaggatgcctgaggacccttaagtataattcaaaattttgtttaatgtgtgttccttgatgaagttctttaggagtcgtagaacgaactgattgcccactgatcatcaaatgcaagttatgaacatttaataaaaatttaaaaccaagagtttcttgttcctgcatttttatttttattgtatggaggggacaaataattattttctgtttagtaacagagcagggtattttgaatttattagggtctttttctgcagtctgggtttcctgtgtacacaaagctacctttcaatattttttattgtttctgttaagattaaatcaatagaggaataaatagctatcttcaaacataagacccaaaggaaaaagatttatagtgatgttctgtcaccttattttttacctgtgactttgtaccattaactttgtcactgagatgttttgattaaaatttttagcttgcttttcttgttttgttaggacactctttttttcttgaattgtttttatcagctttcgtttgcaaggctagtgatgattctcttgttctgtataaagtattgttgactcatttctgaagggagttttagtaatttaagaggttataagtttttaaataaaaggtttattaatttatatatattaaagaggcattttaaaataaaattttttttaaatgacatttttacacctttcaactctaggtttaaaaaataagtggttcacagtagttcttgcagaagaatattttcttttacatagaatttttaagctgaagagaagtagtagtaggtccatgagatttatgatctgtgcttggcaggtaaacctgcttccaacaaatttagttggatttttcttggattctgggtaaatacctttttcttccccagtttcactactttattttcatatgtatctctgagatagagaaatatttcagtcagtgctgctaaaattgttccttataactcgtttatccttttaggtccttccagaatctctcattggtactgaaactcaaatgggtactttcttcaccatttatttctttagaataagtaataagaattttataagcttttttatatttcacgtaatttgagactattgaaaatccagttaagtctctctactgtgttgagaggcattgattcaagtacctgtgttactttcctgtgctgccaaaacagatcacctcaaactaagcggcttaaaataatagaacttaagttctcgtgattctggaggccagcactttgaaatcaaggtgtaggctcaattttactccctctggaggccctagggggaatctgttcttgtgggtttcaacttctggtgactggtggcattccttggcttggggccccatcacttcaacctctgccttacagtccttgctgccacctcttctgtctcacatctcactctccctttctcttagaaggatgcttgtcattgggtttagagcccacctggatattccgggatgatctcttcatctcaagatccttaattataactgcaaagagcctttttccaaataagaaaacattcacaggttccagggcttaggatgtggacacattttttgaggggctgcccttcattcccccacaacaatgaactccatagttctgcctattcagtattttgtagttatttcgtagtttaacttgccttatttctttaggtatttacgtattaaagcattttggtctctgctttctttaacagagaacctggttttctgtaataagtttacttactttcccataatcttttagtttcttatttacagatttaccttcacatatcccttaagtagaacatttgattaactgttttattttcggaacaaatctgcattctgtataataaccaacttattcatatttcggtattcttttaattcttatctgattctgaaattaccatcttgtgattatatatatatatatatggaaataactgaaatcttgataaattaaaggtgatataacttctaagacaattaattatgtatgatgtggtgaatatactggtgtttggtttgtttgccacttaaaagccctatctataggataggaagtaacttgaatgtggaatgcttagagactcagagtaagaggccgtatatatatccttgagctggagtttaaggaaaacttatgggaaattaaaaggaaagttggagtactgacagaggattgcgtaggactcatgaaaaaggaatgaagttaccttaaattctatcatcgtgagttaacgtgaaactagatttatgttagtttatagcctagaattctatcctaggaatctagatatatcctaaatgttgagatagctgcataaacaataactgtaatcgttatgataaataatgacaaatctttttagcatgttttgtgaagctgataaatgttaataggatgtcttcaaatgtcagaattcttttttctttgcttcttttttaaaaaatttcttttcccccattcctatgcaatacactgaaaactgatcattgaaatttgtaggccaaaaaattaatcaacacgtaatagattggggtttgggtttttttgagtcagggtcttcttctgtcacccaggctctggtgcggtggcaccatcatggctcattgcagccttgaatgcctgggttcaagtgatcctccggagtagctgccgtgccattatttctagctaatttttaaaagtttttgtagaaatggggtctttctgtgttgcccaggctggtcttgaattcctggcctcaggtgatccttctgccttggcctcccaaagtgctgggattacaggtgtgagccaccatgcctagcccctaataaatattctaattaccgatttatcttgcttaaatcagttggtaacacttggaatttacttcagaatatattttacattagtggctctgactgctaattcccccttctccaaatgctaatgtaatataacaataaaatgcacagttcttaagtttatataaaataaacaggttttcagttgacctgctttaagtgtaaaatagtgtgaaaaacacaagaaagaagataaagaatttaagattttgacatttctctaatatgcccttaacttctccaaggattcatacttttttttgtaagacagaatctcacactgttgcccaaaccagaggtgcagtggtgcagtctccactcactgcaacctctgcccccgggctcaagcggtcctcccacctcagcctcctgagtagctgggactacaggtacacagcaccatgcccagctaatttttttttttggtattttttagtgggggtagagacgagattttgccatattgcccagtctggttttgagctcctgggctcaagtgatccgtccttgatccaccatgcttagctgattcatactcttaactgaaacattgttccaagtttctcagaaacagtcaaggctttttatctagagaacatttataactggatctttctttgtgtagcactgattcatcaaactaatcctaaactcctaatgagttaaatttatattctgaatcttgctgtaaaagcagccattcattagaatgaaacatgtttacttagaattggagaagggagcttataagtcatctagtctactcccttttatgacacttctacattctttctgcacttctgccaaaatgttgcccagcgtcgtctctgatacctatagtcctaacaagaatatgaatcataccttgtatccttaattttactcttctctgcttatttgccattcatgtgaagaccttaaatagatcttaaattgcttccttcactttagctgagagtgacaggactgtgtaggtgtgggtgtgtttctgcatttgcttatttaagcaggataataaaaacttttactataggaaattaaacatttcccaatcaaatacaattccagtctaacacaattaaattctggttagggaactgcttaacttactagacttataggaaaatactaaaaaaatgtaactagaactctatttttacactttataaatataaacctctgtgaacaaaccagttatttcaggttgcatttgtgtatagttttttaatgcctgatttttctattttaaaatcacagatgcaattatacattcaaacactgccacaatactttgagaaagttaaagtttcccctactcctacactgcgtacacctttcctaggtacatcccagtttggtgtgtaactttagatttcttccaagagcttttgagtaagtgtttgaattgtgggaaggttctttagttaaatgaacttcttacagatcagttttttagtacagtagcacgaaatatacctgcatacctatggggatacctctgtgccattacgatggaaggcacgggaaaacagcactccgtatatacctagtttactttccctcttttgtatatttgtctgattttgtggagctgatgcttctcaagtggaatcagaagttaacttttcctttactattttctcattttattatggtttcttaactagaggttgatgttagtggttggaccattcaatagtaagtaatgacttttcagtaagggatctctagaacccagatcccttaattcctgcaatattcccgtgtgtacattgttccaggtgctgtcctgggtaccaagggatacaatgtttgatagacaatgtacctgccattatggaggtcacattctagtgtgggaagacaaacaataacaagaaaatgaaaatttactgtgccatgccaggttgtttagcctggtgggtgagaggtaggggtttggaaaatcttactgagcaagtgacatttgtgtggagctctgtaaaagggccagcttggaaggtaatgtagtcatccaggtgagaaatgatggttaggggagtggaaagagtggatgttaagattgaaaagaattccaaatctattttagtggtagctgatagggctttgtgattgaatgtggaggaaaaagaagagggtgggttagtaacacactcagtcgcagttagtgagtgctgctgtgtgcaagtattgttctattatgtaaataattccatctttacaaagtaggcaccattcttcctcttttacagacaaggaaaagggaacacccatggttcacatctgtagtagcctagccaggagtttcaggcacttattttctgaagatgctctgcctggcaatgtggttatattggttgaaatgagaccccctactttcaaggtattcatctaggaaagacatgaactgccaattacaatataggataacactgaaattagagacgtgtttattaactttgccatacagaggtaaagtaactctttaaagtaactctttgcttgggttagtggagaaggctataaaaattacttggagtttttactttgaacatgcgtaattaacatggaatgtttagggaaaagaggttttcaattgataacataataaacatgaggagtttgaagcatggcattcaaggttttctaaattctgccccggttaacttttccattcgttggtttcattctagtctagcttttccttctgggccgcccctccccacattagaccgctcctctctggaattccaactcaagcccttgcttttctccatctgtcatgatgttaccccatctcattgtcagggtaacttttatgtaatattaacatatataatactgatataacattagcatattttaatgtatggatcatctcctctgcaacattgtaacctcttggagatggcaataatgggaagaatgacttgattttactttttcttttaacaaaaatggtggagtagtctgggcacggtgtggctcatgcctgtaatcccagcattttgggaggccaaggagggtggatcacttgaggtcaggcattcgagaccagtctggccaacattgtgaaaccccatctctaccaaaaaaatacaaacacttactgggcatggtggtgtgtgcctgtagtcctagctactcaggaggctgaggtgggagaatcacttgaacatgggaggtagaggctccagcttgggcgacagagtgagaccctgtctcaaaagaaaaaaaaggtaaaagggccaggtgcggaggctcacgctggtaatccaagcactttgggaggctgaggcaatggatcacctgaggtcgggagttcgagatcagcctgaccaacatggagaaaccccttctctactaaaaatacaaaattagccgggcgtggtggtgcctgcctgtaatctaagctacatgggaggctgaggcaggagaatcacttgaacccaggagacagaggttgtggtgagccaagatggcaccattgcactcccgactgggcaacaagagcgaaattccgtctcaaaacaaacaaacaaacaaaacaaaacagagagaaaaggcagagtactctagggaattctagtctgtgtttctgtggaaatgtatatgaatctcacttttaagggatggagatttttgaatggcataactagttgataagttttgctctaacagggtacccaagtctagtgagtccgattcattctttccttaaatagatgaaggaggaagaaacatgactccaccctcaagagtaaggcagaatgagcaaagtcagagaagttaaaaaagaattctcacgcagccagcagtgcagagaaaccttggtttagttgtgaatcaaaaccagtactttttgtaatttttgagcctatgcaattctccaaggttttatgttgtttcttctgtttctctgtaggcaccagaaatcaaaaccccaaataagaaagtgttacttgaagattttagagtacttatttgtgtataagtgtaagtgatatttggaagacgactttactgcgctcctccagcttggcatgagaattccaggggcggaaagaaaggagggtgatggtacctggaaaggagagtcatgttaagtcccagccacatattaagtgctaaccacctactgttaaaaggtgtaatgttctagactgacaaaatacatagtctctaccgtaaagtaacacataatttagcagtgcagaaagatgtcacttaaaagaaaacttgaatatatgctgagatagttcacaaattaaagaaatgaacaaagaactgaggaaataaaggaggaatacaactgtgtccaaatgaatacttaactgggtgggagctgttgcatatgtaagcaggtggttcacctaaaagttggatgtaacgtagttaacgccagctcttggtgcacttacatattgcattgcttccgggcttaatttgtgttcatataggaataaattttttgttggtttttaattttactccttgtaattccgtggttgatattcaaagtgaaaaaaattacataagcttctaatatatgagaagtcttctcacttgacattttttatttggaatttttgcagagagtagttttgtcacagtcaaaagattttgggatcttgcagtgagaaacctaggtgtaattcctatttctctgccattccgtatgtcatctggattaagtgtcaacttctcagtctcaagattctcgtccttaaatggaatactttttgtcatgctattttgaagacaaaatgagataatacgtgaaactgcctagctcagtgaatggtacatcatagatactcagaaaaaacacaccctctaaaataagaacagtaccaaaagacaggatgtaaaataagggcagtaccaaaagacacatgcatgctgagtgtatgagaaagaactttgtggccttcttgggtggcacaggccatggcagttccacagcatgacgtggttgctgtgggtggtagagcagacatgccgctccccgtcactgcctggctttgatgcttgctttcttcagctgagaggacgcagctgtgatatgaaggtcttgtgtgtacagtcgtgacctcacatttccaatttcctgctggcagaacccacagtctacaacgtacgagcaccagagttgacgtgagacagacagcatacagaggcttgtaacatccttctggaaaacactgtgtaagctttcagtgcgaataaacatgatcagtggcaagttctgttagatgtagtctgcaagcatcctgattttactgggcaagactatgttgatttacaggcggctgatgattccatggatagcccactactagtattttcacaaatttcacaagacattcttactggaagattgccctgttcttatgatactgctgcccttttagcttcatttgctgttcagactaaacttggagactacagtcagtcagagaacttgctaggccacctctcaggttattctttcattcctgatcatcctcaaaattttgaaaaagaaattgtaaaaattacatcagcaacatataggcttatgtccttgagaagcagcagttaattacctaaacacagcaagtaccttagaactctgtggagttgaattgcactatgcaagggatcaagtaacaataaaattatgattggaatgatgtcaagaggaattctgatttataacaggctatgaatgagtacctttccatggtcgaagattgtaaaaatttgttttaagtgcaaacagttttttattcagctttgaaaatgacttgcataaatctggagaaagattatcaggatttaatatggtgaattatatggcatgtaaacatttgtggaaagcaagtttagaacatcacatattcttctgtttggacagaccacttccaactagaaagaatttttttgcacattattttacattaggttcaaaattcctaatgcatggtgggagaactgaagttcagttagttcagtatggcaaagaaaaggcaaataaagacagactacttgcaggatcctcaagtaagccattgacgtggaaattaatagtttgggaagtagtaggcaggaattcaatatctgatgaaaagattagaaacataaagccttccatcacaattcccacccggaacaggaattcctactcatcaaaattctgcattcatacaagagggaacctgattatgaccatcttctgttggtcatttggtagattatgtggttcacacttcttccaaatatttgcaaatcagacatcaccattatcagcacaagctaatagcatcattctggaatcatcactattacaggacacccctggagatgggtagcctccagctttaccacccaaacaagctaagaaaaactgttggaaccaaattcattatttacattttcaacaagatctggaagatcatattaatgaaacgttgatgttctatcttctcttaaaaaatctgctcctaatggtggtattctacatgataatcgtgttctaatccgagtgaacctgacgaaaatggaaggtttggagtcaatgcaaagggggatatgatcagaagatgtctgtgatcgtgtcctgagaagcaccaggaacacctttgacctcagtgactctcgattgaagagaagaccaagttgtattgatcagtggttgggactttacagaacacacccatgattgggttgtcctgctttttaaagccaactgtgagagacattctggggaactcatgcttctagttctacctatgctgcatatgatgtagtggaagaagtgctagaaaatgagacagacttccagtacattctggagaaagccccactagatagtgtccaccaggatgaccatgtgctgtgggagtcagtgatccagctaaccgagggcttatcgctggaacattctggacacaatttgatcaacttatcaaaaaaaaacttggaatgacaatttctggtgccagattaccttagaacctttgcaaaaatagatagagatagttttccttatgatgttacatggcttatttttaaaggtaatgaaaactacatcagtgtaattccagcatcataagtcagaacagtgcttgtcaaggggcgttaccacacacttgaacagatttttggcagatgacttgggaacaaggctcctccatgtttgtaatgttgaccacacaagttgaatgtggcagagttaaatgaccccaatattggccagaacccacaggaagttcatcctatggatgctaccaagccttctgccactgagaagaaggaagcactgtctttatcttcaggaagatcacactgctgtttaaccaagagaaaaattagagagtcatcaatcacgcagatccagtacagagggtggcctgaccatggagaccctgatgattcagtgactttctggattttgtttttcatatgcaaaataagagggctagcaaggaaaaaccccttgttgtttcttgcagtgctggagttggaagaaccagcgttcttaatactatggaaacagccatgtgtctcattgatctcattgaatgcagtcagccagtttattcactagacatggtaagaacaatgagagagcagtgagccgtgatggtccaaacacctagtcattacagttttgcgtgtgaagtactattttgaaagcttatgaagaaggctttgctgaagaaagcaaaaggaaaaaaagaactttgtcatctgttaggttccatttattgcatgataattgtgtttgtattgattattgggcaagtagctgtttgctattttgatcttatttcagaagggcataataattttactattcaatgaaacgttttaaacggggtagaaaaagactagtttttgtatgctttacagcagaaatcttataatgattaactggtaatatatttcgttggcataaaaatacatttaaaagttcaagtaattataaacattgtaaattgtatatgtaatcatattgaaattgaaattctttatagctgtacttctgtgtaatcaaagactggggagagatagactagctagctctttctcttatccattaatcacttaacagagttttgaataaaaagttccatttcatgggataagaataatgacaggttaacctattttagttggttactatgttctaggtgttgtatgaagtagtttacatagtttcactgatttcactacaatcccaggaggagtagttactattattacactcattttacaggcaaagaaataggtttggaggggttgggtgttttgcccaagttctcatcgtaaaatgacagatgaggattcaaattcaagtcttaattgaagtccattactttagaacctacctcttagtggctcttatgttacagtataagggagagcagactgttcctttacccttgtagggtagctagggcttgtgaattaagagactgattaacaggagaagaggcatacacattttattgacgttagtatttttacatgcacagggaaggagggttttatttttatttttatttttatctttattttaaagagacaggggtcttgctgtgttgccagggctggactcaaactcctgaagccaagcgattcttctgcttgagattcctgagtagcagggactataggtgtgctcctctgtgcttggctaaagaaggggtttgtatgtgatttttaacaaaggctgataaattgtgaagaagtgactagtcaaaggagaagaggatttcagctcccaggggtggtaaattgtgggaagatgactaggaaatgtatagtaataaggtttgctatgcaggtttattttgccagtttctggtctcctaataagggacagggaaacacctttacagatggaaattcatatcacctttccacagggaaatttatgtcctgccttaggcagttaggggaagggcagagaattcttcctgtatctgctgtgtctcaggtgccttcagctcaaaataatccttatgccaaagtagcatatttgggtgtggcatattctctgatctctttcaacagcatcatctatacttaacaacagcaaaagttttttttaaaaaatcatgtttcaagatttgcatgtggaagacaaatggacatgattgagataaatgaagaatatatattttttaacaaagaatgctgtatatttatgtctctgtgacattgtgttatggaggctaaggtgttaagcatgtgattactttagatgccgtatgactacctgtttttaagattaaaaaagaatcaataggcagtttatatgcatgggagcaagttaaaaacaacacagatgtgatgaaggcgaggtgaaactggtccgcatctaattcaggccttctcctgaaagccagtgtgtgcaagataaataagtttgtttgacgaaagcagaataactagtttgtcctttgtgatgaagatagttattcagaaatcatttttattggctacctctgaattaataaatgaaaagagaaatttttttttctgtaggggatgtctgatgagttcttaaaaagtggatgaacctgaaattatcatgaacaagcaattataatgaacttaaaattacttaaagagttatgaaaaacaaaaagaaaagccgtatgttttcttgtgccttattttgaagtgacaaattatttgcagggtacatttgtagacggaactaatgtgatttaaaaaatgagtactagatttacagaatgatgcctttaaaaagtcactggtgcactttaattattttatttatgtttattctgaaactacctttattttgaaaatgaggtatagctttgcctactggtgacaaaagtgtaaataattcagtaaacatctgttaaaaaccagcttggtgctaggctcttggggtagaaaactgatcaggccattgaggagctcatagtccctaaggggctggggacttgtcattaggtgtgcagtgtgttctggatgctcctgaaggagtgtgggcaggtgcgcaccaccatgcctggctaatctttttataattatgtagagacagggtctggctgtgctgcccatgctgggtttgaacttctgggcttaagagatcttccctccctgcccctaccgaccccgcccgcccactccacctcagcctccccaaagcactgggattgcaggcatgggccactatgcctgggctgtgcaaaacttttaaatcagtgcatactcaatggtcttgatgcaattctggcttgttggtaagagaatggggatttactcacaagccacgatgtcacttttaactctgaacagatcaagctattggtattactcatttatgtcatcgataaactttatgaataaaaactcattgtgcaaatatttaaacatactacatacatagcactgtgcagtttctaaggaaagtaatggaaacctttgtcacatccctggcttccagaactttatgttatctaagtgcatttgtctgcaaagttgttgggttaattgcccctttctttcttctctttttaagatattaataaatagtgtcatgaccaaaagataatccttatggacaagatagatctaaaaagccttagctaatttataatcttgcataatccatgatgacaagatgcagaaacaaaaatgcccagaataaaaacttagcaccattagcagccatttccttttaagtctttacaagtatactcccagtttcttgaaaaatttattctaaaatatgtaagacacacaaaacagcagaaggactaatacaggtacatcgaacacctgtgtgcctaccgcccagtttaaaaataaactggaatgatgtttctctcatacttacagaataaagttttaatctttagcatggaattcaaaagacttctgccattccagttcagagccacccttctggtctccttgctcctcagccgcgacactgcccatgtacccaacaggcctccagggttactgcttccattcgttcttattctcatgaacattttccttcatctcatctgccagaatcctacctaataatactcctgctctgcagtttacagttctttaaaattaaaaaaggttgtgtaccctttagtgtcctgaaaaaagaaaaaacaaatttaaaaccttaaaaaggtaccatattttcatagtatttgcgttatgtctcattacagttcctgtggacatgtctgtctcttttactagattgattgtgggctctttgaaggaagatatatcttatgaacagtgttttatatattgttagcaatcaatgaatgcttgctatatttttctcatgaggatattgattattctattttaatttattaccnnnnnnntgtactatacataactgctttctgtacctgagctatttatgatctctgaggctcctgtgagaaatctaatttttgttaatcatggatggaaatattcacaacatcattcgtcagtttcttcacattgtcttcctttgtatattacagatgttttaaaatatcaaagtaatgtttttttgttttatcttttagatattgctatatggagatttgccaaaaaataaagaaaatataatatatttagcaaatcatcaaagcacaggtttgtatttcatttgcatgaaacctaggtttttctacagatggcacatgggcattcaaaataccgttcttatatttaaatgaagtgggttttttaaaacagcaattttctgtgcagatattacacctgttcttgtatttttgtgattttactttttggaaagtcagaaacttgaaagctatgaattttcctaaacttaccttctccctctgttggatgtaagtaagctatcttcttacttgcttgctttgtttttcctttgtgtagctctttaaagagtgtattcattctttttgtaagtgatgtttctagaagtagcattggtgggtcgaagtgtgtatacattttacatttttgattgctaagctgcagaaaagctgtattggtatgtaagtactcgtttccttactatgctcgtcatttctagtgtctgctcttcctttccttcttcaaatgggtttggtttaattctagttgctactgttccatcagaggaattgcagagaactggtcttcaaaacagtgcagtatatactttaggtgaagatacttctaaaaacctttgtattttgaggtaattctagagtcccaagaatttgcaaaaagagtacattgtcagcaatatttttcccaatggtgacatcttaatataactgtagcacagtagcagaatcaggaaattgtcattgggtaaggtactttttaattctccaaataattcagccctccaaaaaaatcccacttcttatgttttcaaacctgtagctacttttgatgcgtacttcctaaattgcatttttattactttaaaaaatataatacctagaagctcaaagctggaaacagcctgatcaatatagtactcttaagctaaaaacaacctgatcaatatagtactcttagggaaatcacttatgcctgtggctttttttaaattttcttcctgtcagctgtctcttcatgattttgtggtttttattactgcttataccatagatgaggtatagaaagtaaaagaagttaaaatgcatttttctcaatttagtgaattaatgattacattcagatttataggacaagggttgaagctancaaggggttgataggaatcttgatgtatctgagtattttccccaactttattacatgactggttcagactattttatctaattacatttcactcttggcagaaatagcaaaacagtcaaccaatggtcaatgctgctgagaactctggcctgtgcagacatattggctgttttacttctaataccattctgcttttcctgtcctgctgctgatggatgtttcttccaggttttaaatatcaaacaaaagggatctgtgggcccagtacagggaatggctcttgatagatttgattttcctgcatttcctttattttgatccagtgttaatttcatgtagagttgtctgtttaacaggattctcttaaaattccttcttcagtttacctgccagcttttctttgtccaggtttcagtatgaactccactcgattaatagagctctctagtagtgacttgtggagtgggttctctgaacatttctggaagtgttgctgatagtgataatattgatcactagtactgttaatttgtgtgcttactacatgttggcttttatatgtattccttcagattaaggacttctagaaaacatccatgaaaaaacagattaaaaaaaacaattctgcatgtatttgggactagaaggtactatgggaaggataatcttcatactcagaccatactgacctgaatttcatttatcagtttagagaaccacttccccttcccttcaccctacctccgagtgcctgtgactttgtatcaccgctctggcaccacatcctcatcccagcaggatttgggaaggctgctttttgaaagccttttaaaattctgtaagttgagaaaatactaggggaatgattttaaatttctttagaattacaggctttagtcagtatatgacagagccttttcctagaaaaatgtgcatataaaaatttgcatgtagttttagggtttcagagacccctaaagcctatccatagacgtggttcattgtctgattgtgtttaggtacccttctaaaacccttttgagatgttaggaatcacaacagagtatctctgaaaatgtaattagcggaaagaacatttcaaagactgttgttctgcttagactttctagtttgtcttctgccaggcttgccggaataaatgagtttcctggcctgatactcaaaagaattgacatttaaattagtctctctcttcccttgttttcgcttgacacatccttgtctctacattctgtctctgtctctgttagcttatttctctctcgagtcagcaggatatagtggctgttatttcttccccttatccttcaacgatctacttttgacaacactttgcctttttttttttgagatggagtttcactcttgttgcccaggctgggtgtaatggtgcaatctcagctcactgcaacctttgcctcccgggttcaagccattttcctgcctcagcctcccgagtagctgggattacagacatgcaccaccacgcctggctaattttgtattttcagtagagatggggtttcaccatgttggtcaggctggtcttgaactcctgacctcaggtgatctgcctgcctcggcctcccaaagtgcagggattacaggcgtgagccactgtgccctgcctgctatttgcctttttaatctcatgaaatgttctcttttcttggctgaagtgtcacttttcttgttgaacagcatgcgtggtgagtagaatgttataaaaagggatggactttggagttagagagacccaggttcctgttcggcattgcagaaatgctgttctgcaataggctgtgtgtcagtgggcaaattacttatctctcagagccttattggtaaggtgtgagtgatagctcctttcaggcaccttacagaggctgtctcctaatcctggtagcgtacctggctcatagatggcatttaaaagtggttgtgatgacagtcatagctcaccattagcatagcgctggatccatggcagggaagcgctgcacatgcagtatctcttggactacacagggccctcatgaattaggaactgctgtttcatgaggatagggatgaggaaattagacttgctgcccctcactgccttccactcctctcctccaagttaatgggaactatgactctgctttggcttgattgccatggaagattctcacacagccaaatttattgctatcttagttaaattatgccagaacacaaaatatgaagttattgtcaaagtaatataatctcagctgtaactgagatagtcagaaactgtctgtaatctgatgtcctatctgaaaggtagctgagaataaacaagaaataaagagaattcagtagcaaatattggtgacacaaagcttttatattttgactagttaagctagttcttaaatgtttccactaaaatattcaagtttaagggcatagcccagggcagcttattatgaacatgatgtattttggaaatcttacactttctcttaaaagttcttgggaggggcatgtgaggccataatataaccataaaaccatttgttttaaaataaaacccatttttaaaattcttccaaataaaaaaattattgcaggaaaaaatgctaaacctggtttttaactttgtacgccaactatatttccaagatgtgctgtagcctggtaaccatacagaaccatacagaattagttctcagaatttattgtctgcttacttttgcatttggtacaggtataacagggtcgattatatggtttctaagacatgactagaaagaaatatgtttatcagttattatttcttccatctaaattagaaggggctagggagagggcttcaacaggaatttatatactttagagaaaagtgatcattgatagcccaatagtatagatatctcaacccaataacacaggttgtgtctgtctctgggatcatacactgtaggggagaatctttgcaagcaacattctacttatagggagccataacaaaagtttcatatgtataataattataagtcttaagtcatcaagaaaaagttaacttgtgaatgataatccctgattaaaaagagagatgtataataatggataagagatttttcttggttaatttttagtattaaaatggctaaatcttctttgggatattctgactagtatggtgcattgtctaatagatttcccatagctgagagctaatcatcttgtaatctgtggaaaactgtcctctttggctaaaactttattgtaattcctctaaatcctcagcttttattttctacagacttttttttttttttaacatttccttcctctgactcactccttttgttctcattttcatggcctgagaacatgggtgatgatagaattattcttttcacagattaacagttttcttttcgagtatcgttgagctcatgtgtgtattaactagagaagtctcccttacatttcatttttatgttttctttctcatcaggagatagtttgtagccatttactttcaaatccaagtttctgcggttcttaagacctgtatcatttgtctcctgaatttcacttcatttcctctttaaaccatgtcctctgtttcccatcttctgcacccactttgccacttcctgtttgtttaattggcaagggccactctctgtgttggaaattttttctttttgaaagctcaactaacaacttctaggaagttttttattgctactgttatcaattcataccatcttacccttgtttttgcaaccctttgttaataacatatttatttaactatagttattagcagtctgagatcattttacttggttacataaggagcacatatatctacccagcatcattgtaaggcatgtgagacctttgtttgattgctgtcctaacctagtaccgagtcctaaaaactcattagtagaagatgaagtgtccttgccttttgctgaacatatatatacacactgaatatttagtggcaattcatagttgcatttggccattttttgtttataatttcccctttctcattaaaaaaactttgttttctagactttaggatttagagaagctcattttgttccatacacatgctgctgttggattatttaggtattttgtgactgtattttatctttgaaataaaaagcctttcaagaaatgcaaaaaaaaaaagctcaaaaaacagaaaatgtatattttttaaatatctcagatagatttaaagaaattttaaacatcctaatcatagtacttttgaagcccattcatagtacaacctgtgaagagcctcatgtacgcgctaactgggtcctgtctctgcagttgactggattgttgctgacatcttggccatcaggcagaatgcgctaggacatgtgcgctacgtgctgaaagaagggttaaaatggctgccattgtatgggtgttactttgctcaggtaacttgtttccatgcttttctctctatatatgtagtttataaatttttttttttttttttggagacagtctcactttattgctcaggctgagtgcagtggtgtgaacacagctcactgcagccttgacctctggggctcaagtgaacctcctgcctctgcctcccaagtagttgggaccgtagtgcccaccatcatgcccggctaaattttctattttttgtagagatgggggtctcgctgtgttgcccaggctggtcttggactcaagcaatctgcctgtctcagcctaccaaaatgctggattataggtgtgaactgccatacccaaccctataaaaatgttatattttaaaatttaacaatatacttcatgtgaatgtatggtttttaaaatgggtttaatagtttattctcagttgaagtaattttgtttggcatttttagtggtgtgtatttatatacgtctgattatccatatgcggttttccttcagcatctgtggggattggttttagaaccaccacagataccaaaatctaaggtgttcaagaccctcatatagaatgggatagtatttgcatataacctgtgcactactttaaatcatctctagattacttataatatctaatacattataaatgccatgtaaatggttgttatactttattttttatttgtattattttaattgttatattatttttaatttttatttgttcacatatttttgatctgtgatttgttgaatctgcagatgtggaactcatggatgtgaagggccagctgcagtaaaatgaaagagcaaaaatgcaaatgtacaaagttcaaacaaataggaaatttaaaggcatagaatttgataggcaattacattaaactgttgataacagtaattagtgatctgtatgatattaaaaaaaaaaagcaaactgtatatataaaacttactttctccagttctggaggctagacatccaagatcaaggtgttgacagggttagtttctcccaaggcctctctcccaggcttgcagacagcatccttcttcctgtgtcctcaggtggtttttttccctgtgcccaagcacccctggcactgcttcctcttcttagaaggactagttacactggatgactaatccttctacagagactgctaaggtcccactctgaggcccttttttaaccttaattaccacctctaagtccctctctctgaatacagtcacagtgggaactattagggctttagtagactgatttgggggaacacacttctgtccgtaacagtgccacataaatatctttagcaggattgattttttaaaatccctaaagatcgtgagtattgacatgttaaggacgctttttagtgactctgtaataagtgggtggaagaattgggagttaaatccatctgatggatcaggttttttatttttaaaaatgtgtatttaagaaagaaagcattttcattttaactgccaacaaaactaaacttcatgtgttttccaatacagtgtcacatgcagtttttttgaattatgttgagacaaggcaattttcagctaaatgttctttagaagctaatgtttgaagatattaaatatagattaaattctgaaatgtagttttcattctgtactttttgcaagagaagttgcctttttgatgactctggccaattgttattttaaaagtaaatgctctttctcccgatttgattgtggcagcatggaggaatctatgtaaagcgcagtgccaaatttaacgagaaagagatgcgaaacaagttgcagagctacgtggacgcaggaactccagtaagagcctacccgtttttatttttcttaccagctctcagtttctaaatttaagaattaaattaaaatctaagaattgttttgacaatgtattttcccatgtgtaattactaattcagggttatgctgaggtaacagaaaccctctatgtacaggtaggcaggtttttcagccatcagaaagattgctgtaaacaactaggtcctttgctggtcagtggaccttaaagaggaataaaaagagcatttggtgtcgttcagagtctataaatagaactaactgcattttaacctgacatttaagctagtttacaagctcatcttacttcttgtcttctttagtatcagatttggttttagaagcagcaactgttttctgttagtgcaaattttgaatgtcttacatgtacagaaaaaccaaaaaaggatgaatctctacaaatgttaaatcattcagtgtaaataatattttataaaactttattccacaaaagtggggagagttcaatctgctttgtatagaatgctgattgctgccaaaggcttttcccctggttccctccggagacaaagcaccatgatcaccggggcgacttgggctttctctttcagtacatgacatgtgctcagaagcttagctcgtgtgcacaggctttccctttcctttctggctccctccctctgtcttccctcctctcctcttgccctcccctcaccaggggtcctgggcagcagctggagctcatggtgaaggaagaattcttcatggtcagctggcgaagtgcctggtgtgagcattgtttattcacatgcctcttctaggtgtttttacattagaacattgcatctgttttgggcatgtgttgggtgacagaagcagaatggaatgagatgaacagtgaccctttatcctgttatagctaacccttgagaaccaagcttggtgtcttcaaagggtctgtttagtctgaaacagtgtggtgaatttgggcagaattgtggtcattgcatgtaggtctccaaaagacagaataagttggtaatatggtttatcgactttttacaaaaaaaatttaaaaatcatgaatttataccttaaaatgtccatcccacttctctcccagctgtccagtcaccccagcaatggatgactgctgtggagttccttctgtgtcctgctgtgggcattgtatatatgaagcaaatgaagatagctgccttttgggtgatgttggcatcctatgcacagtggtcccttgcttttttgcccccatgaatatagctgccagtggcgctagggctgaaaaaatcagctctttacacttgtcatgtgtcttgtttatgtggctgccttcgtgagtttcttcttgtttttggtttgcagcagtttaagtatcatatatctgagtgtcatttaaaaatttttacctggattggtcctctgagcttggatctatgatttggtgtctgttattaattttggaaatttctttgctcttatttccttaaatattattcctaccccagtctttcttctccagttatgtttgtgttggttcatttctcgctgttctttagttcttagatgcattattcgttttttgttggtttttttttaaatttttttttttacgccccctcccttttttctttttgtgttacattttggataatttctgttgacccacctttgagttcatggattcttcctttggctgtgttgagtctactggtgagccagtttaaggcactcttcatctctgctactgcgtgtttcattcctcacatttccctttgaccctgtttcatagtttccatctctgtgctagtgtatctatctgatcataaagcttagtcacgttttccagttgaacctttatcattttattatacttgcagttctcttaaattccctgcttgataattccaacatctgggccatatctgagtctgcaaattttgattactttatctcttcagattgtgctttatcttgcctttgtcatacttcctaagattttgcctaacgctgggccttttttgtaagacaggagaaatggaggcaagttgtcttgatacctggaaatggatagacttgtctttctgcttggcttttagtgttgaggagtggagtcagtccactgaggaggtgcactgcatttgggttttgctcatgtgctttttctcacagcttcaggtttctgtagaactcattactttgtttgtaggttggggatgtcctcccgctagagcttttcctcagtgtctatttcacactcagcgttttcacatagcaccttggagtggctctcttctttatgcctttccccactatacttcttggatacttgttactgaactctcgctagtttggtggtagaaggagagggaagggaagtgtcttttcattcttagggagaatctcaggggtggagccttctctgatcctgccttgcttctggctgtaagtctgtgcccagtatgtattcctgcctttactaagagtttttccctgttctcttcacccagcctcatcgagtattcatccgtgccccatgggtagcagggttttgttgcccctgttcatcagtttcaggctgctgttccataggaaaggtagaaagaaggatgtgggctgggccctgagcccttcccacagggctgcttttccctcccacaagcctacatccagtcttccctgaccgcagtgtgttttcttttttctttgtcttgtgagtacacaggaggtctgtgggtcgagcctgtgaaatgtgctgcattctccttgtgtctgtagcccaggggttcgtctgttccactggctcatacttggctttctgcaaaattgataaaatttttagctaaattctttttactggtatctgttacattggcccccaactaaacaaccacttgcatcttgtttctcctttgagttttccatctttccttagacttttgggttagttggttgccttgcaaccttgcagctctctgaagggtctaagaaaagtcatgaatctacagcttgtcagtgttgttgttgttgtagggttggcagtagtattccttcagcattctacatacttaatggaagccgcctcccatttttggttaataaatttcaaaacttggaacaatgttagatttacaaaaacgtcagaaagaacagagtgttcctgtttattctttatatagcttttttttttttttttttttttgagttggagtctcggtctgtcacccaggctggagtgcagtggcacgatcttggctcactgcaacctctgcctcacgggttcaagcaatctcctgcctcagcctcctgagtagctgggattacaggcgtgcaccgccatgcccggctaatttttgtatttttagtagagacagggtttcaccatgttggccaggctggtctcgaactcctgacctcttgatccgcccgcctcggccccccacagtgctgggattataggtgtgagccaccacgcccagccttcttcatctagctttaacatctaatgttgacatcttacataacatggtatatatttgtcaaaactaagaaataaacattggtaccacactattaattgtactacagatttttattcagactttaccaggttttccactaatgtcctttttctgttctaaaatacaatccagaatagatacaaatccattcaacttcagtgttttaaattattgtttttcattatatgaagtgctgtgtggtttttgtcaaatctgttattttggttttaatcttcaagcttgtctttgtttctttaagtgataaaggcataatttaaaaggtgtgttgggttatttcagtgcctaaagtcttgtctgagtcacttgttttctgctgttcttgcttatggtactttctttccttgtttgctttgttatcttcctttgctgctggctgtgtttggttaagttatttgtggaaatcagttgaagcctcaggtgggagtgtctttctccggagaacatttctacctgttttagctgggccccttaaggctcctctagcgtgggccccacccaaacgagattctgagttgaaggtgaactgagccattcaggcagtgcagccagggttgcagatgcacgtgagacctgctcacctctcatttactttcaccctgagagtagagcctttggtgtttcgttcacttgtctgattctctcttcacagttctattagaaggtccatgggttttggtttctgtgcccttcatcttatgagtcttgtaaatcaaagttctgttttatgcttacttctgctttactgtgtttgcttaatttcagtcttaacatcttgccaactcttgggtacttttaaaataatgttatatccagctttttaagttgttttcagtaggaaggttgattcaaataacctagtctggttatgggctacgagaatagcctccctgttttttgtgggcaaaattccagccttttatgttcctagcgcagtgtggataacagactggcaggttcaagaggccgtgctgagcagctttcactgtaaggtcactgtcccaggtcgggtttctaagaatctggatggttgtttcatttcttaatatgtacgccctgtgagagcggatacatcttgctcaggttcttatgattcttttgtttctgaaggtgaattaagtaagtgacatggtagaatatgttaagtcaactttcgtgtggcttactagttctcatgaatctattccatgattgtatcagttcttattcagtattagtatttaagaaatgcagaattttgtttcaaaaaatatatttgtattataagttgtgaagaaatacatctccataattattgctgggacaatacagtattttcttaaggaacttattggttgtggatgcaaatgaagcatatttgtgataaaaataactaatagaagtcattttgttagactatgagctagtaaaacttatggcacaaacatggagacttaacactttttcttccagctttcacttaagttccttttcagataggaggcagcctggtggataagagtattggttttgaaattagattcaggtttaaatcccagatcttctgtttaatctttattttatttcaggtagattttctggataacttgctatagcttatacgtcagtacttgccacttcaattttatgttatggagagacggcttctttccttaaacctcacgaaccaacctctgctagcttctaagttttttcctgccacttctttacctctctcagccttcagagaattaaagggagttagggccttgctctggattaggatttgctttaagggagtgttgtggctggtttgatgttttatctagagcactcaaactttctccatatcagcaataaggctgttttgctttctaatcattcatgtgttcagtgaagtagcacttttaattctctttaagaacttttcctttgcatccgcaacttggctgtttagtggaaaggacctagcttttgacctaccttggctttcaacataccttcctcactaagccatttctagctattgatgtaaagtgagagacatgcaactcttcctttcactggaacgcttagcagccattgtagggttattaattggcctaatttcaatattgttgtgtctcagggaatagggaaacccaaggggcggtagagagaaagagagacaggagaacaggccatcattggagcagtcagaacacacacgacatttatcaattaaatttgtcatcttatatgggtgcaattcatggcacccccaaacaattacaatagtaacatcagagatcacagatcacaataacagatataataatatgaaatattgtgagattaccgaaatatgacacagagacgtgaggtgagcacatactgttggaaaaatggcaccaatagacttgctcgatgcagggttgtcataaaccttcaatgggaaaaaaatgcaatttccgtgaagctcagtaaagcgaagcatgataaaatgagatgagcctgtcactcctaagaatgttcctgtacaagttttttgcatctgttacttaccttttcctatttgtgaatagtatcttttttgagtacgtgtgtttttttatttttatacatttatatgtatcttttgaagaacatacttttaagcttaatttattgattttttttctctcataatttccactttttgtatcctatttaagaagtccttgccaaacttaaggttgctaagattttctcctttgttttcttctggaaattttagagttttgcttttacatttagttctaggatttatttataattaatgttttcatatggtgtaagatcgaagttcatatttttttaatataggtaaccatcactatagaaaagattatttccccccaatgtttgaaataagtagactgaatatagatgggtctgttatccctagatcaatggagcatttgttctgttatattgatctatatatatatatccttatgccaataccatactgtcttaataatgcttgctttgcagtaagtttttaaatagtgtagttgtcttctaaatttgttctttcttttcaaagttgttttggctattttaggttttttgcatttctgtgtgaattatagaattagctcgacaatttctacccaaagtttgtgggcttttcattttgattgtattgaagatatagatgaatttgggaagaattgatataacaggattgaatctttggattcatgaacgtagcctgcatttgtttacttaggtcttctttatttatctcagtgtgttttgtagtttaatgtacagatttgcacatcttttgccagatatatccctaagaatttcagtttttgatactattgtagatgacatttaaaaaaatttcaagtttttgtttgttgacctaggcatatatttgactttttaatatactaaccttgctaaacttatttatcatctagtaacttacaaaatatattccttaggatttcctacataaacaatcatgtcattgttttagaaataacagttttactttgtcctttttaatcttgatggcttttatttctttttcttgctaaattttctggctagacctcctagtacagccttgactagaactggtgtgagggaaatcctttccatattcctcatctttagggaaaagcactcattcttttatccattctttagttcctagccccattgcccttcctaaattttttctcatcattttccttcatcacaccttgttctttttctttgcaatcatatcatgatatgtaacgacatgtttttatttatctgtttaatgtatttcttttcctcacttgtccatgaagggaaggaccatatgtgttgttatcctttgtgcagttcctggaacataataagtatataagaaatagtttctgaattagctgtgaatgaattcatgccttcctgctgtctgtcaatgttcttttaaattaaacatctaagacagcaaataataccacatgagttattaacctgagaaataatcgttttatttataaatgactgagttgaaagctgatagcccacagtaattgctttcatggctttgaatataaaccttactgttacaaaacacattttcatgaaaatgaatgtgtggtgtttggaactagctttaatgtttgtcttcctgtttttccttctagttgctataatataataaggaattttgtatgtttttcctaattgtacccacttttctacattttcttaacagatctggtgaatcttcattattaaatataattatacatataaattattgtttaataataatattaattattaaaaataatataaattattaaatataaagatacatataatattatctgttaatttctaagttaggtgtgggttctgaagactattatatgaatgaacaaaaagcttgcatatttgcgtggaagctgaaagtacgaaatttttagataccattataccagtatctaaagaaaaaattcagtaccacataggtttttaagtaggagctgtatgatcataggtcatccagatgaaggaaggcttctgtaccagacgtacagaggtagacagtgttgtctgagtactgtctgagatctggcaagaatgaatccaataaacgtagttttctcccatgagctcctgtcttgtttcctgtattctgtttgtatttgaaaagatttggtgtgcataacttatttttgtcttttggctgtcaatcaaagttattagtgtagtttttgtaactcagttctcaagctaggagtttttgctgtataattttaatgtttctgtttttactttcctaagcagataagcgtaaaaacttagactaattgattacttattaaacgtccagcttgatattcttctttatattattttagtttcagtttatataacaaatgaggtttcttataaataaaatttaaaatgcactaaaggagctgtgtgaaataggaattctgtgtgaagcttttgaatgtgaacatttagaacgtttcacatggtgggaatttactatatgattttcatcaaatgaggtactttttagtgttggtacttaacgatactgatttctaaaatttgtatttctaaaaatgacgtattacaggatctgaaagggcaaaaactcattgaggctttgtatgagtcagcgtttcatggcctatttttaattagtgaattattagcatataattagaaatgtttttagattcttcatggctgacctaccaatgaatgtagcactgcatttaaaatatagttcacgttatgttcatacttaattgttgcattttgtttgcccctcttgaaacgaaggtcacatgtaaataaatatacattttctcctactgtaggaaatactctgttagcattagtaggtttagcttttttaggttaacaataacaaaaacaaagctcacacaaaataaaccaaatttgctctatgtcccacagatgtatcttgtgatttttccagaaggtacaaggtataatccagagcaaacaaaagtcctttcagctagtcaggcatttgctgcccaacgtggtaagtaaaaatttgagtgtttgaacaaataattttcaaagataataacatttttagtttttcttcctggaaaagatacttttgttttacagttgaaggaatgaatgtattcattccttgaattagtgtacatattatctcttaggaaatgaagtttcttctccttaattcactttcatgctattattacatatatctgagaaattaagttgaagtgcttgttacgatacatattcttgtgccatggatttatttaaaatctatctaagtacatgattatgtagatggaagctttttctacagtgtatgggttatatgtaatggagcttctgttttgtaagatgacagacctaagttggagtccaaactcgtacttttattagctgtatggttgcaacttggaagttgtgtaatgttgctgagcttgcttcttcatctcttaaaagaacatatgccttataagtagatctaaatctgtgtgaggattagattagaaaatatgtcaagtttctattggagaagttacacaaagttggtccacagtgcttggaagctgttaatgtcttcaacaatggtaatgttcttaatatccatattttagaaaattgaataattggtacaccaataagctatgcaatttaaccaaattgggaagtatacagaaaacagtggctatgctatgttcttagaggtgtctttgaagcttgactgtgatttagtgtgtgatctccatatgttgatagtcactcactgagcaaataccttgttggtgacattacagcagggcctatgacagtgctgtctaatggaactttctgcaataatggtaaagttcttcatctgttctgtccagtgtgctggctcctaccaatgtggtttttgagcattcaacatgtgactagtgcatgaaactaatttttaattttatttaattttagtttaattaaaaataagggggagtttttacaaggtgcttacaagagcagatatgtcataggtatatgacatcatttgtaacagtacttttaaaaaatgccagtttgtttttaaacacatgtcctattaagtaaggagtgtttcagaataggagggttcagttggtctccccatctgccagctctcttttgactttcattgcttcctctgtctaatagacatgacgttctgtcatttcagttgctcttttgcaatgccattgtctcttttgcccttttcacatttattaaacagaacaaaacaaaaaccactctcgaatctgtagtctacctttgttgtaagcactttttccagtactcactctgccctcaatttgttttggtctgatttgaaattctctccctagacttctgtggggctgttctccattatcctcccaactctctggcgattacttcctagcctcctttccagcctctttctgcttcatttctccctgctacatgtgttatttccagtgtcaggttttggtgtttgattaatttcactttttgtttctcatggtggccttcctctaaatccatggctttagccatcgtttccttgactgctgatgactcgcaaaagcttcctcccctccatgtctctctgcctaactctggacccatttgtacaattgtccattagagagcttcgcttgactggcccaaaaggatgtctcaaactcagcatattgaagatagaatttatccttccatgcatacactcatatttcttgtcttggtaactccatcattcagtttttttgcctaagttttattcacaaaaagaacaaattgatagcagttgcatacctcttataggaaacttagacatggaggaagaagctgttcagatggggtcctgcagaagtgcaggcactgtggtaatatttaaacttttctcagctgttcgaagggttttgttttaactaattttccttagacttgttttaggtatttggctttctaatggttataagggatgtggaattaaatgtatcttaatctgccacctggacccattaaagtaagcccctatggtggtttttttttttaattgccatggttaaaaccatagttgctagcgaaggtgacatacttaagctttttgaactctcttaaaagaaaacagaaatttaatgatgtgtctataatggcaaaccagatacctagaatttccatgttattcatagggtgaataacactggcgattgtagagatttgagagttctttcaaaacaggagaacaaagggaataagctacaaagcaatttttttctttgtagacttaactgaataaaaattatttttatgtctcaaacatcatatgaacaaatttagttggcaaatggcaagctaataatattttataatataggatattaatatacttaatattacaaaagtgcttcataattagaaaagacataaactagaaaaatgggaaaagggcatgaataagaaattcaagagatacaaatgacccacacacttgaacaaatgtttattctttctcataatcaaagaagtagaaattaaatgaatactttgaagccaacttctgagaaagcatagcaaacaagaaagctagtgctcagctttgtgtggtaacggcactctcgctcttaagaaggtgtgtttgctccctgtggctgctctcaggcagggccacaaacttggtggcttaaaacaccacagatttcttctcttacatttgagaagtctgaaatgggtcttactcagctgaaatcaaggtgttggcagggctgcagtcctttgtggaggcttggggggatcttgttctcctgtacggggtcctgtgcttggttcggggtcctgtgcttggtctgggatcctgtgcttggttcgaggtcctgtgctgggtccagtgctctgcttttaccaccttgaagttcatctggaaatggcactggctcgcccacaccatatagctgactctggttctccctcctcctcactcgctctaaacctgtgtttttggctgatttctaatctctctttccttggcccttctgcagcttgcagggccttctgcagctcttgtctgccccagccccggggtctgcccatcccagtgctgggctgttctgttcctgccctgcctttcctcagcccttggcaaccctgtttgttttctcccttccttagcagtggagaacatcgtaagatcaatgctgactgccttctgcagccaagccaggccatttcatttcagccgagccaagtctgtgtggagcagttcttttatttttctccttttgactacctcatggttttcacggatttttgttctcttcacattcaaggattttttgctttcagaaagttatatttctctggaaagagtgcacccaatatcccttttgatttcaaaatcttaatgtggagtctcttgacttggatttctttggaagaaactgctgaagctgccatgtctaagaagaaaactttggagaaaaattttcttcttagacatggcaacgtcaacagtttctaagctcttgattccgtctaccctgtctccatcgttgcctcagtcatctgccttacttctctgcaggggtttctcccagcttgcaaatgtactccaattctgaaataactaagtctatagctgtgcaaagagaagtctgggccccttgctttcttgtgtttgactccatccactctccagaaatgaatcccacttctcacttaaccactgacctccaaagcatcgtatcatttgtgtcagttgtcatatttgttaactttcacataacttttgacattatttatacctttataaccaggaaataattttaactttattgtagaaataaacaatggagtataatttttcttgttgaagataaatatcacctcctcttcctttaaacatctcttccctttgtttttgtattacattggtttcccccctttttttatttcctgggttgtcgtattccctgttattatttttacctttttttttttaatgtggatgtttccggagtctgtatttcttgccttttcatcttctgccctttattattctcagccactgccattacttcagttatccattcccatggtttccacatgcttagcttcggttgattcttgccattttacagaccatatttccaactacttctagaatgttttgttccttcagcctcagtatgcccaatttgaactcatgttctctctcccccttctttcttccttctttctttcgctctctctcccttccttcttttctttccctccctccctttcttccttccctcactcgttctctcttgcttgcttgctttctctcctctctctcttttctttctgcnnnnnnnnnnnattcttctccctccctctcttccttctctcccccactccccaacttccaggctaaagcagtcctcctgagtagttaggactacagacatacacgtgccaccgcgcccagctccgtgttctctttgtttccctgcctcctgctcttccacttatctttgcatggcaggtgggtgcacgcaggcatgctctgcatgtcttcctcttggccattccccttctagttatggtgtggctttatctacgcgttctggagcagaagcctagtcacaaagctatttttttaaaacattcatgataattcatttccttttatgttttaaaaatactagctttctgtctttatttccttactaacttacttggatgccagtaattagttgttttagtgaacaccacagagtgatattttgaaactttggacttcataaagttggatgagctccagtagcaaagaaggaagtgttaactagtttaactgacaaataaatgcttcccagcttggtgtgcgattgagatttttgttgcaagtttgtgaatcaatttaactgcccctgccctggggactaaagtcagatacgtgcttgtgggaatctttgtctttcccacaccaccctgcattttaaaacctcttgtgtgggacagtcccaccatgtaatagctgttcttccttactcagctactttccctccagagaggccagtagaaaatctagactagttttttatagtctattttcatgtcacttattgagagctactgttttctgttaaattgtcagtaaatattttaatcaaggaaaagggaggcaataggaaggagagaagaacaaatccttaaccctagtaggaacctaatgaatgggatttgttctggataattgcagtagtcccccagctaaagaaccttttaaaaatatgtcagatatacccaagaggattgaaatcgtatgttcatacaaaagcttgttcacctgcagccttcatatgcaattcctatgaatgttcatagcagcattattcataatagccaaagtatggatgcaacccaaatgtccatgaagcaattaataggtaaacaaaatgtgatctgttcacacagtggaatactaactattcagccataaaaaggaatgaagcactgagtcctgcagccacacagatgaacctcagatccatgctgagcgaaagaagccagaaacaggaggccatgtgctgtgtgactgtatttctaggaaatcttgagtcaccatgggcaagatgctatcacctttgttcagtggccagaagcgagggcactaatatttacccttgccggggtctactagattgaagcgtttccgctaggccataaacttccaacacggtgacttgtacatgtagatatttgatcaatatatagcaaatgaatattgatttaaacagaaaaaggcaagtgagagtgctttctaaacttagagccctaaatatatgaggttgtggaattaatagattctgttgtgtgtgtttgagggaatttaaaaataatttagatgttaaacagtatattgtggaggtgttttgtaactaattaatgacggcactgaattgacttctaggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacgggtaagtgtgttcacgcacctgaaatgcctgtacacggtatatacagtgcacatgtttatgtagaattcagttttacaaagtaggttaagtgtacttttttcctccattacatttacccggtatatttttcaagatgttattaagatgtaacagtggagatttcattagtcctgcaaagtgtggtatttcttggctgtcgtgtgagtcctgtggactcaccaattatcattaatccagcctctttctactcaaagttcacacttaaaaggaaagctctgtaaaagggaggaagacgtgaagaaggagcacgcctggcagtactgagtgcacgttattagtcagtgctgcccttttgctgtatttttcgtaaaatatttattaaatttgggtgtcattgtgacaagaagaaatgcagttaagtgtgacctttttttttccccaaacatgttaggttttaagaacctttgagctattgtcagatataaccagaaaaaaatagaattttaagtgagcaggataacttagttaaactaaccaaacatagtgttagctgttagagaaatgtaaacatggaaataggcaaacagggaagtgtgtggagtttctgtttccttttcaaaatatctgtttgagctggggttgagagagaacactaggcttcatggggtttttttgtttttcgttttttgttttgagacaagagtttcgctctgtcgcccaggctggagtgcagtggcgcaatcttggctcactgcaacctccgcctcccacgttcacacgattctcctgccttagcctcctgagtagctggaactacatgcgtgtgccaccatgcatgactaatatttgtatttttagtagatatgggatttcaccttgttggccaggctggtctcaaactccttacctcaggtgatccacgcacctcggcctcccaaatgagctttgtgtttttacctcatcagctgtttggggttgagccactatgtatgtcagtgtgcttgtatcagtaggatctactgagggcagatgttcaaaatatgagcctccagcacgttttacatggaaaccctcacctgaagcattcgtctgaagttgatgtgccttggaaattttatagagtaatatttttaactacaacaaaacatttataaaagtagacattattaaagcattcagaagtgagcaaggatagaaattattctgcccaaccttacacgtaggccttctagacgtagtactgtgcaccgttacattatctaacactgtctgtgtgtcatctttggatgttagggatttttccaaagttcagtgagattatagttgtcaaatgattagtctgttaaataatgataagatgagggtcactcaggttttaaaagaaaagctctttgactgaaagagagagcagctgtctactgcagaaagttagggagggaggctggaggagtgaggcccaggggctagctagtataaaaattggttatggtcgaaggaaaaaaaaatgtaacatatttatatctgaaagatgattgttctcataattgtatataacacagagtaattgtaaagtagaaaactaaggtgtttttcattttagatgtaaatgtttagaatatgtaatgcatcagtttaaaaattaaaactgtacgaaatgcacagtgaaacgtcttccttgctttccaccctgctacctggccttcccttctccttcctagcgataaccagttttcttaatttgttgtgcgttgtatgtgcaaatttaagtatatcttcttattctaccatccctcccttcttacagaaaagtggcatattaatatttttctcttttaaactatcgaaggagttacttacctatttttgcatttcaaaacagacagttcatcaagattgtcgttggtttattaaacatagtttaagattaaacaagtgtttataaccaatgaaaaacagatagactccccataataaccttgtttaaatgctgctacttttatcatgtcccctcctgtctaagaaccccttggttcagcagagctcatgggtaaggccagcctctgttgcctgccatcggaggaatgcgttccagccgtgatctctgccttgccttcgcttcctcctgtgctgtgccgtgaagcctcggccgtggtgaagctggctgactgagtcctcctgcaccccatgcatattcagtagttgaaggctttgtgtggccaatcctgctttccacaggaaaccaccctctcttttgttgccctcatccaaggctactgttctcccagagtgacaggcggcacctttcccagcatagcactgtgccttctcctgcccctgctcttgcagtactgctgtggcactgatggcgtgtgttacagtgctggcacttagcacagggctctgcctttctctcttcccagccgcatcataagtgccttgaggaagccaaaaccttctgtgagttgcattgcctgggttccaacctcccactgccctgcttatcctctgctacatgtgagctgactgtggctttggggtggtcactgcctatgtgtattcattacaaattgtctccttttgaaagattgacctttctgacttacccagataccataaagaaaataaaatcttatcacttcagtcaaggataaagtatttctgaattaaaggaaaaatacaccagagtaaaatcaagactgaaagacaaactgggaaattatttgcaacctagatcatagaaaaggggtcatttccttcttgcgtaaagtgcacttacaaattgataagaagatgactgataactagaaagaaaaatgggtaaagaacaacaatagacatttcacatttaacctcattcatgataaggtaagtgcaaatgaaaactacaggggatacctttttttttttttaatccattagattggcaaacatcccaaggtttgatcataggctcagtgggtgagatttaagtattatcaggcatttttatactttgctgttaggaatgcaatgtagtacaaacctttgtagaagttgctttggaaatgtctctcagatgtacaaatgcattcacattttagatttagcattcccgctttctgagacattattcaacatgtatacgtgtgcacataagatataataataacacgtttttccttctagtgtgttgcttttaacctgtagcttgaaaaaactctgctttcattgtttttttttgttttctgtcactggctcagccctgctttcaattgtttatatgaattgatgggtgttctggtctggttataatctactttagtttaagagtcactttaaattatatgacatctgatataagttgtgttaggtagaaaattctgtaacttggaatactgtaagtactttgtggccacatttcattagtattaaatattatctctatatatagtaggctatttaatattcatattttatgatgcaattaagaaataatttttttctgaagttggtagattgttgatatgccatggcccagtgtttctcaaagcattctgggggatcactgtttgtcagaattagctgcagtgattgttgaacatgcagggcctctgctccactccacgttgctaccaggacgctctgcaggtgagagctgggaagctgtagaagctgcagtgctaacaaatgctacaggaattcttgtagtcaccttcatgaggtcttatgttgaggagaggcagccagtagtgtcccttgtccttcccgttttatggtgtaagtttcattttaagggaggtataaatcaaagcccacctgggcattctctcatggttcactgcttcttgtaatcatggaagatgtcattgcggcagagacgaaacagtgtagtttgattactattgatttttttttaattatttttctgaagtggctgttgtaatgtaataaattgtgtgcttaaggacaacctttggtattctatttgagtattgtgtatgatcctagttaagttttttctaccagtattttcatattacaacatatttactttccatttctattaatatttttatatttaaagtatggaggccgggcacagtggctcacgcgtgtaatcccagcattttgggatgctgaggcgggtggatcacaaggtcaggagttctagaccagcgtgaccaacacggtgaaatcccatctctactaaaaatacaaaaattagccgggcacagtggtaggcacctgtaattccagctactcaggaggctgaggtaggagaatcacttgaatccgggaggcagcagttgcagtgagctaagatcgtgccactggactctagcctggctgacagagcaagaatccgcctaaaaaaaaagggatcagggaagaggggattacagataacccaaagaagaaggaaaaatctccacaagttcacctgtccagcggtaaccccaatttggatattttcctttaacaatttggatattttcctttaaatcctcttttttataatgtctatatgttggagagagtatgtgcctttacgtattttttaaagatgagatttctgtgtgtgtctatatctcctgttcttcatattttcttgtgtgttataaacagctgtacatgtcagtatatatacttccgtaacttttttttaaaggctatatagtgttcattgatgtgatttaacagcagttatctccccggcttcatcttgttggaatgtgggtcctgtgtgttgccttcagagcaaatggggcttggttttgcagcaagtagacctgtgacctgtacgaatagttggaagactttctctattacccaagcgtatcagtatactttagtgcctactagaaatttatgggtagaaaaacaataatatcttagagtattttttcctagattccctaaggtgctatagggtgatttttactcatgtaacatgaactatgcttcaactaagatagtttttgcaaatgtggatatataagtactttattaaacctataggaagtatttataccacttatttcctcccttcagtgttagaacctcctaaatggcatttgacattgaactgctttccactttgtcgcatgctcctctcattgtccctacctgggtcctgaaccttagggacttggctgttatagccccaccatggctacgctgggccttggtcgtctctgagacttagtttcttcatcttacaaggagataataacagcccctgcctgcgtagaattgcagagatcaaatgaaataattaacatactcaaaagcatgccgtaaacacattctgagcacatgtacgttttaggaaaaacaaaaggacccatgcacatttcggagtgcttttgtctcagcagcactgcctcttcttccaaagctgacgtcttagtagaggccctgccacgtcctgagcactgtactccacgaagcattctatttctgacattcgaaatgcagtctgttccatcttccttacaatctgtatgccagcacttgaaataccgggtatctgcagtgttgaccaggtgattacttaattatggaaatgttgaggtggagatctagataattcagtgaaggcaggaaaattggtgtcggaatctgtctttttatgtgtcagaaatagaaataagatagggtgagaagtaatttgtggctaaaacactataatagctaacacatagtgcatactgtgtgccaagcactcctgtaggtgcttgaaatcttctattattattatccctactttatagacttgcacccttaggcacagagaggcggacagttgtccaaggttaccccagaggtggagatccaggctacctgactccaccatgtgtgctcttccctagggcacagttgtgctgctaaaaatactttttaagcagttctttgattattcagatgatagtactgtaggaaaattaagacaaaaataatgaaaaattaaaatctttattttagtgttttgcacatgtattattaaagccagtttactcctggaagtgtgtaagaatacagggtatttttgatcacctaaatgctgcatgttactaagagctcgacactgaagtcaagaagagcagttgcagagagtacttagcaaaaacgggaagtgtgtggggttgaaggagcaaagacaagtcttcctcggacggtggagtgtagaattcatcatttctcagaacacgtctttgaacgcattttcaatttgaggccaaaggtctcagcctcccactcggcatacctccctaccttagtcagctcttaaatcttaggaatatttctttgttcttcaaggaacttaaatatgttaacattcttacctgtccacagggagccccctacaaagaagggagtttctagtctccgttctttcttggaataaataatagcctcataccttgtgcaatcgaggctgaaaaagactgtctccttttttcaaataagcaagtcttagaaactacagttgtttacagggctcatggctattccacagtaataattttggttcttttaccaattatataatatgttaaaatatggcaagtatcaggaaagcaaggagtggcaatgattagaaaccaatggccaagttagagaggaggggcaattgctcccccaagtttgttgtggctgtgtagcagtcagtgacgagaagctgtgtgtcaggcgacaagcaaagttgaggattatcaggcgcctgtgagtgcccagctgtgtgccaggtcaggaggtgccatcgtgagccagaccagcttcctctcggcccctgtggagctcgcagtctggtggggaggcagcagtcaccatggtgacaggtgacacactaggatggggctggtggtggtaggcatttgcgggtcccttcagagaggtgagtatggacttagaggaggctccagcttcctattcctgggctgtctatagcactaaaagttgtcacatgaaaaataacatttggtactattgatttaacttaatgacttatgtaattgtagttgacttagaaattataacatgctcttctacttcagcttgaaacccccaaccaccagtttataatcctttttttttaacttttgtttatttttcctaaggaatctgtactttttcttcattttacaactttttttgtcctgttaccttattttcatttttactttatatgaccatgagttctaaaatagtaaaaaaaaagaattatttttgttctttgttagaatttctctgcaaagaatgtccaaaaattcatattcacattgatcgtatcgacaaaaaagatgtcccagaagaacaagaacatatgagaagatggctgcatgaacgtttcgaaatcaaagataagtgagtaacaacagttccagcacttccggaacttcggttcaactagatttcagtatagtcaacaatttgaaaccaatgtaaatggttatattgtctcaagaatacattttataaattcaaatcaaattttatgcatgtctgatcgtgttttaaactttacttgtacaaatcagtctaaaagaacttgttacagtgggcccatctacttgcattgatagtatttcttggacaatactacgtgataacatagcaaattaaattaaaaacaacaacaaacacacaaaaaaactttccagtgtcagatgcccggacctacctgtcaggtcacataaagtggtgttactgtgtgaggtctggctgttgggccagtgtgcgcagaaaagcaagggaggggtagaggactatgcggacgtgcaggtggacatgatgctgttatatttgttggaaatagaagggggcagttgacagcgttatatccaaagtgtcttctgtggttaattatattcagaaattttagccaattgttttattctctaaatatgtactttctgctcaagaaactatcattgttcttcttttccttgttttacagtacagtgtttttaattaaccctcctgggttaactttaccaggtgaaaatgattaaaagtgtaataggttaacaatgaaactttaagcttctatttttcattgactcttaactgtacatgatgtaatgtattcagcgagccattcaggaccactttggcccatggaagaaatttaaaagtaagatctacatgtattgacatgaaaatatgttctcagaaaaaagactaatgtatttaatgtcctacttattttataagtatttagaatacctctggacattttaaaacaatgattattgctagggtgtgtgatttataaagcaatagaagcgctttccctttctgtttgtgttttagattattatatcgggtatgttctgctatcataactttacaaatcttatgtaatatgggaaaatgagttaactatgctgttttccttcttttacctgcctttctaattctgtgggaataaaggcgtttttgagacagcccaggtgtagtgagcagtccatatccatggattccacattcatggattccaccaagcacagaccaaaaatactcagaaaaaaagggggctggctgtggtggctcatgcatgtaatcccagcactttgggaggctaaggcaggcaaattgcttgagcccagaagttcaagacagcctgggcaacatggcaaaaccctgtctctacagaaaatacaaaaattagccaggcgtgcacctgtagtcccagctactcaggaggccgaggtgcgaggatcacctgagcctggaaggttgagactgcagtgagctatcattgtgccaactccagcctggtaacagagtgccttttttcaaaaaaaaaaaaaaaaaaggatttgggaggatatgcatatgttatattcaaatacatgccattttattcatatatcagggacttgagcatcctttgatcttggtctctgccgggtatcctgggaccagccccctgtcgatacagagggaccgctgtctaagaaccgctggtcctatctttgacttctggcggaataggagctccatgtaaaaaggaggagaagctgcagcgggttattagccatttgtgagtcaggtcactgtaaaactttatcaaaagtttaaaagacaaaaagcatcctcataaaatgccttaaaaccacctgttgaaatattacatatacaattcatgtatactaatcatagagcatattaaagatattttagaagactagaaacttctattaaaccaagtttctggatgtttccgtattcatccttattttccagggacctgcataacttttccagcgtgtaatagctacctgattgatattttttgaattgaaatactgaagtgactaaaatctaaactttttccattctggccataggatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaattggtgataaaaagttatttcttgtatatgtgataaagtttacatgttgtgtatatatgttgtattgccaaatacggctattaaatactacgtcatattttaaaggttcagtttgtagtgatagtaaacaagcagtgcactaagcctcttgcgggcatcatctcatctcactgtcatcacaaaccccatgccacagcgtagcttgaccactaaaagtaatgcatctgcaagcatactgccaggttttggatagtttgtaccaacagttaccttatcaaggtaaatcccagactctaaaagagttggtgctgtgtcactacatgcataactttaaataaatttcctgccgggcgcggtggctcacgcctgtaatcccagcagtttgggaggccgaggcaagtggatcacttgaggtcaggagtttgagaccagcctggccaacgtggtgaaaccctgtctctactaaaaatacaaaaattagccaggcgtgtggtggcaggcacctgtaatcccagctacttgggaggatgaggcaggagaatcatttgaatcctgcaggcggaggttgcagtgagccaagatggcgtcattgcactccagcctgggcgacaagagcgagactccgtattaaaaaaaaaaaaaaaaaaaaaaaaaaattcctctcctgtttgagctttcccttacctgtaaagaggggagaatatgtatttacttcaaagagttcagggaaatgactctcactagtttgagattctaggtataaaaatacattcttatataattttaacaccaatgtgagagattattattcttgctaaaccaattcagttttatttgctgtctaaaatgtgtgaataagtaattgtccattattttctgaagtgttttggaactcaacacatgattgtgaggaggatttgttgctaaacatctttctggttattcaagctcgtgtatactgtgctctgttgagacatgcagagttactttctgtctgggtcacaggtcagttcttgatagttttcggacaattaaccagttttcatttgcccatgaccacctttattctttttcctcaactgcacccatcttttataaggtctttcagtttattgcagagaagatggtggagaaaagccggaattcccacccaccgctgccatccccatgttttatcattggctagagtggaaaatagcagtaactactgtgagagatcatttgtttatataatggaaacaaagatgaggaaagaacctggcttagatcagagaactgatgtatttagattctttttttttttttttttaagacggagtgttgctctgttgcccagactggagtacagtggctcaatctcggctcactgcaacctccatttccctggttcaagcaattatcctgcctcagcctcccaagtatttgggattacaggcgtgttccaccacacctggctaattttttgtatttttagtagagacggggtttcgccatgttggccaggctggtctcgaaatcctgacctcagatgatccacccgccttggcctcccaaagtgctgggattacaggcgcgagccaccgcgcctggcccaatgtatttggattcttaaagaacactttcaaattaaatatcagttgaagagaactagaactaaagaatttctgtgtcaaactgtttagcaaatgtaagtagaagctgggagatgtgtcctggaatgaatgaatacatcagtaaaataccatacgtatgttatgatgttattgtttccttgccttggttgatttggttttactgtgaaataattttcaatatagaattgtgatcgttggaatttggtcatctactagaaaatgagaaagaagttaatagctatcttccttaaagatttctgaggttgggattaaggtagtgttcccaaggtgttctaaaacggcagcgagagctgtgcactcacttcacaaatttgaattcctgctctgtgttaggcgctg

SEQ ID NO: 2 - DNA, 23 bp, Homo sapiens
ggtcgtccagcgcttggtagaag

SEQ ID NO: 3 - DNA, 5227 bp, Homo sapiens
  polyA_signal (5180)..(5186): AATAAA
  CDS (31)..(1092)
  misc_feature (5209)..(5209): n = a, c, g, or t.
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctatcgaaattctgtgtctccagcaggcaagaatacttgactaactctttttgtctctttatggtattttcagaataaagtctgacttgtgtttttgagattattggtgcctcattaattcagcaataaaggaaaatatgcatttcaaaaanaaaaaaaaaaaaaaaaaa

SEQ ID NO: 4 - protein, 353 aa, Homo sapiens [sequence omitted]

SEQ ID NO: 5 - protein, 364 aa, Homo sapiens [sequence omitted]

SEQ ID NO: 6 - DNA, 26 bp, Homo sapiens
  misc_feature (1)..(26): primer oligonucleotide GC1.5p.1
ctgtccctggtgctccacacgtactc

SEQ ID NO: 7 - DNA, 26 bp, Homo sapiens
  misc_feature (1)..(26): primer oligonucleotide GC1.5p.2
tggtgctccacacgtactccatgcgc

SEQ ID NO: 8 - DNA, 27 bp, Homo sapiens
  misc_feature (1)..(27): primer oligonucleotide pg15RACE196
caatatctggaccccggtgtaattctc

SEQ ID NO: 9 - DNA, 34 bp, Homo sapiens
  misc_feature (1)..(34): primer oligonucleotide GC1.3p
cttgcctgctggagacacagaatttcgatagcac

SEQ ID NO: 10 - DNA, 24 bp, Homo sapiens
  misc_feature (1)..(24): primer oligonucleotide PGRT32
tttttttttttttttttttgaaat

SEQ ID NO: 11 - protein, 6 aa, Homo sapiens
  SITE (1)..(6): box2 from SEQID4 (aa 160-165), present in AF003136, P33333, P26647, U89336, U56417, AB005623.
FPEGTR

SEQ ID NO: 12 - protein, 6 aa, Homo sapiens
  SITE (1)..(6): box2 from Z72511(aa 129-134)
FPEGTD

SEQ ID NO: 13 - protein, 6 aa, Homo sapiens
  SITE (1)..(6): box2 from P38226, Z49770 (aa 223-228)
FPEGTN

SEQ ID NO: 14 - protein, 6 aa, Homo sapiens
  SITE (1)..(6): box2 from Z49860 and Z29518 (aa 90-95)
FVEGTR

SEQ ID NO: 15 - protein, 9 aa, Homo sapiens
  SITE (1)..(9): box3 from SEQID4, present in AF003136 (aa 211-219)
LDAIYDVTV

SEQ ID NO: 16 - protein, 9 aa, Homo sapiens
  SITE (1)..(9): box3 from Z72511 (aa 204-212)
VEYIYDITI

SEQ ID NO: 17 - protein, 9 aa, Homo sapiens
  SITE (1)..(9): box3 from P38226 (aa 271-279)
IESLYDITI

SEQ ID NO: 18 - protein, 9 aa, Homo sapiens
  SITE (1)..(9): box3 from Z49770 (aa 265-273)
LDAIYDVTI

SEQ ID NO: 19 - protein, 9 aa, Homo sapiens
  SITE (1)..(9): box3 from Z49860 (aa 138-146)
VPAIYDMTV

SEQ ID NO: 20 - protein, 9 aa, Homo sapiens
  SITE (1)..(9): box3 from Z29518 (aa 218-226)
VPAIYDTTV

SEQ ID NO: 21 - DNA, 47 bp, Homo sapiens
  allele (1)..(47): polymorphic fragment 99-123
  allele (24)..(24): polymorphic base C
  primer_bind (1)..(23): potential microsequencing oligo 99-123.mis1
  primer_bind (25)..(47): complement potential microsequencing oligo 99-123.mis2
tttctcatcctcacacctcactgcgcccctcctgaacccactccttt

SEQ ID NO: 22 - DNA, 47 bp, Homo sapiens
  misc_feature (7)..(7): n = a, c, g, or t.
  allele (1)..(47): polymorphic fragment 4-26
  allele (24)..(24): polymorphic base G
  primer_bind (1)..(23): potential microsequencing oligo 4-26.mis1
  primer_bind (25)..(47): complement potential microsequencing oligo 4-26.mis2
ccctgtnagacacgtcctgtatcgttgttgagatgggaaagtgcatc

SEQ ID NO: 23 - DNA, 47 bp, Homo sapiens
  allele (1)..(47): polymorphic fragment 4-14
  allele (24)..(24): polymorphic base T
  primer_bind (1)..(23): potential microsequencing oligo 4-14.mis1
  primer_bind (25)..(47): complement potential microsequencing oligo 4-14.mis2
gcagggagcagaccagacatgatttgttctagtctagctgattcata

SEQ ID NO: 24 - DNA, 47 bp, Homo sapiens
  allele (1)..(47): polymorphic fragment 4-77 extracted from SEQ ID 1, 12057-12103
  allele (24)..(24): polymorphic base C
  primer_bind (1)..(23): potential microsequencing oligo 4-77.mis1
  primer_bind (25)..(47): complement potential microsequencing oligo 4-77.mis2
gctgttcagactaaacttggagactacagtcagtcagagaacttgct

SEQ ID NO: 25 - DNA, 47 bp, Homo sapiens
  allele (1)..(47): polymorphic fragment 99-217 extracted from SEQ ID 1, 34469-34515
  allele (24)..(24): polymorphic base C
  primer_bind (1)..(23): potential microsequencing oligo 99-217.mis1
  primer_bind (25)..(47): complement potential microsequencing oligo 99-217.mis2
atatagttcacgttatgttcatacttaattgttgcattttgtttgcc

SEQ ID NO: 26 - DNA, 47 bp, Homo sapiens
  allele (1)..(47): polymorphic fragment 4-67 extracted from SEQ ID 1, 51612-51658
  allele (24)..(24): polymorphic base C
  primer_bind (1)..(23): potential microsequencing oligo 4-67.mis1
  primer_bind (25)..(47): complement potential microsequencing oligo 4-67.mis2
gccagtgaaatacagacttaattcgtcatgactgaacgaatttgttt

SEQ ID NO: 27 - DNA, 47 bp, Homo sapiens
  allele (1)..(47): polymorphic fragment 99-213
  allele (24)..(24): polymorphic base T
  primer_bind (1)..(23): potential microsequencing oligo 99-213.mis1
  primer_bind (25)..(47): complement potential microsequencing oligo 99-213.mis2
ccttagcattcaagcccctgagctctggtgttgtccacccctggggg

SEQ ID NO: 28 - DNA, 47 bp, Homo sapiens
  allele (1)..(47): polymorphic fragment 99-221
  allele (24)..(24): polymorphic base A
  primer_bind (1)..(23): potential microsequencing oligo 99-221.mis1
  primer_bind (25)..(47): complement potential microsequencing oligo 99-221.mis2
agcttgagaaaccagaaaagccaaaaggaggctcctaccacatgggt

SEQ ID NO: 29 - DNA, 47 bp, Homo sapiens
  allele (1)..(47): polymorphic fragment 99-135
  allele (24)..(24): polymorphic base A
  primer_bind (1)..(23): potential microsequencing oligo 99-135.mis1
  primer_bind (25)..(47): complement potential microsequencing oligo 99-135.mis2
agtcactatatctatgtttaatgaagatagaaagagatgcagaaatg

SEQ ID NO: 30 - DNA, 47 bp, Homo sapiens
  allele (1)..(47): polymorphic fragment 99-123, variant version of SEQ ID 21
  allele (24)..(24): polymorphic base T; C in SEQ ID 21
  primer_bind (1)..(23): potential microsequencing oligo 99-123.mis1
  primer_bind (25)..(47): complement potential microsequencing oligo 99-123.mis2
tttctcatcctcacacctcactgtgcccctcctgaacccactccttt

SEQ ID NO: 31 - DNA, 47 bp, Homo sapiens
  misc_feature (7)..(7): n = a, c, g, or t.
  allele (1)..(47): polymorphic fragment 4-26, variant version of SEQ ID 22
  allele (24)..(24): polymorphic base A; G in SEQ ID 22
  primer_bind (1)..(23): potential microsequencing oligo 4-26.mis1
  primer_bind (25)..(47): complement potential microsequencing oligo 4-26.mis2
ccctgtnagacacgtcctgtatcattgttgagatgggaaagtgcatc

SEQ ID NO: 32 - DNA, 47 bp, Homo sapiens
  allele (1)..(47): polymorphic fragment 4-14, variant version of SEQ ID 23
  allele (24)..(24): polymorphic base C; T in SEQ ID 23
  primer_bind (1)..(23): potential microsequencing oligo 4-14.mis1
  primer_bind (25)..(47): complement potential microsequencing oligo 4-14.mis2
gcagggagcagaccagacatgatctgttctagtctagctgattcata

SEQ ID NO: 33 - DNA, 47 bp, Homo sapiens
  allele (1)..(47): polymorphic fragment 4-77, variant version of SEQ ID 24
  allele (24)..(24): polymorphic base G; C in SEQ ID 24
  primer_bind (1)..(23): potential microsequencing oligo 4-77.mis1
  primer_bind (25)..(47): complement potential microsequencing oligo 4-77.mis2
gctgttcagactaaacttggagagtacagtcagtcagagaacttgct

SEQ ID NO: 34 - DNA, 47 bp, Homo sapiens
  allele (1)..(47): polymorphic fragment 99-217, variant version of SEQ ID 25
  allele (24)..(24): polymorphic base T; C in SEQ ID 25
  primer_bind (1)..(23): potential microsequencing oligo 99-217.mis1
  primer_bind (25)..(47): complement potential microsequencing oligo 99-217.mis2
atatagttcacgttatgttcatatttaattgttgcattttgtttgcc

SEQ ID NO: 35 - DNA, 47 bp, Homo sapiens
  allele (1)..(47): polymorphic fragment 4-67, variant version of SEQ ID 26
  allele (24)..(24): polymorphic base T; C in SEQ ID 26
  primer_bind (1)..(23): potential microsequencing oligo 4-67.mis1
  primer_bind (25)..(47): complement potential microsequencing oligo 4-67.mis2
gccagtgaaatacagacttaatttgtcatgactgaacgaatttgttt

SEQ ID NO: 36 - DNA, 47 bp, Homo sapiens
  allele (1)..(47): polymorphic fragment 99-213, variant verison of SEQ ID 27
  allele (24)..(24): polymorphic base C; T in SEQ ID 27
  primer_bind (1)..(23): potential microsequencing oligo 99-213.mis1
  primer_bind (25)..(47): complement potential microsequencing oligo 99-213.mis2
ccttagcattcaagcccctgagccctggtgttgtccacccctggggg

SEQ ID NO: 37 - DNA, 47 bp, Homo sapiens
  allele (1)..(47): polymorphic fragment 99-221, variant verison of SEQ ID 28
  allele (24)..(24): polymorphic base C; A in SEQ ID 28
  primer_bind (1)..(23): potential microsequencing oligo 99-221.mis1
  primer_bind (25)..(47): complement potential microsequencing oligo 99-221.mis2
agcttgagaaaccagaaaagccacaaggaggctcctaccacatgggt

SEQ ID NO: 38 - DNA, 47 bp, Homo sapiens
  allele (1)..(47): polymorphic fragment 99-135, variant version of SEQ ID 29
  allele (24)..(24): polymorphic base G; A in SEQ ID 29
  primer_bind (1)..(23): potential microsequencing oligo 99-135.mis1
  primer_bind (25)..(47): complement potential microsequencing oligo 99-135.mis2
agtcactatatctatgtttaatggagatagaaagagatgcagaaatg

SEQ ID NO: 39 - DNA, 18 bp, Homo sapiens
  misc_feature (1)..(18): upstream amplification primer 99-123-PU
aaagccaggactagaagg

SEQ ID NO: 40 - DNA, 18 bp, Homo sapiens
  misc_feature (1)..(18): upstream amplification primer 4-26-PU
tacagccctgtaagacac

SEQ ID NO: 41 - DNA, 18 bp, Homo sapiens
  misc_feature (1)..(18): upstream amplification primer 4-14-PU
tctaacctctcatccaac

SEQ ID NO: 42 - DNA, 18 bp, Homo sapiens
  misc_feature (1)..(18): upstream amplification primer 4-77-PU, extracted from SEQ ID 1 (11930-11947)
tgttgatttacaggcggc

SEQ ID NO: 43 - DNA, 19 bp, Homo sapiens
  misc_feature (1)..(19): upstream amplification primer 99-217-PU, extracted from SEQ ID 1 (34216-34234)
ggtgggaatttactatatg

SEQ ID NO: 44 - DNA, 18 bp, Homo sapiens
  misc_feature (1)..(18): upstream amplification primer 4-67-PU, extracted from SEQ ID 1 (51596-51613)
aagttcaccttctcaagc

SEQ ID NO: 45 - DNA, 20 bp, Homo sapiens
  misc_feature (1)..(20): upstream amplification primer 99-213-PU
atactggcagcgtgtgcttc

SEQ ID NO: 46 - DNA, 19 bp, Homo sapiens
  misc_feature (1)..(19): upstream amplification primer 99-221-PU
ccctttttcttcactgttc

SEQ ID NO: 47 - DNA, 18 bp, Homo sapiens
  misc_feature (1)..(18): upstream amplification primer 99-135-PU
tggaagttgttattgccc

SEQ ID NO: 48 - DNA, 18 bp, Homo sapiens
  misc_feature (1)..(18): downstream amplification primer 99-123-RP
tattcagaaaggagtggg

SEQ ID NO: 49 - DNA, 18 bp, Homo sapiens
  misc_feature (1)..(18): downstream amplification primer 4-26-RP
tgaggactgctaggaaag

SEQ ID NO: 50 - DNA, 20 bp, Homo sapiens
  misc_feature (1)..(20): downstream amplification primer 4-14-RP
gactgtatcctttgatgcac

SEQ ID NO: 51 - DNA, 20 bp, Homo sapiens
  misc_feature (1)..(20): downstream amplification primer 4-77-RP, extracted from SEQ ID 1 (12339-12358) complement
ggaaaggtactcattcatag

SEQ ID NO: 52 - DNA, 21 bp, Homo sapiens
  misc_feature (1)..(21): downstream amplification primer 99-217-RP, extracted from SEQ ID 1 (34625-34645) complement
gtttattttgtgtgagctttg

SEQ ID NO: 53 - DNA, 20 bp, Homo sapiens
  misc_feature (1)..(20): downstream amplification primer 4-67-RP, extracted from SEQ ID 1 (51996-52015) complement
tgaaagagtttattctctgg

SEQ ID NO: 54 - DNA, 21 bp, Homo sapiens
  misc_feature (1)..(21): downstream amplification primer 99-213-RP
ttattgccccacatgcttgag

SEQ ID NO: 55 - DNA, 19 bp, Homo sapiens
  misc_feature (1)..(19): downstream amplification primer 99-221-RP
tcattcgtctggctaggtc

SEQ ID NO: 56 - DNA, 18 bp, Homo sapiens
  misc_feature (1)..(18): downstream amplification primer 99-135-RP
aaacacctcccattgtgc

SEQ ID NO: 57 - DNA, 47 bp, Homo sapiens
  allele (1)..(47): polymorphic fragment 99-1482
  allele (24)..(24): polymorphic base C
  primer_bind (1)..(23): potential microsequencing oligo 99-1482.mis1
  primer_bind (25)..(47): complement potential microsequencing oligo 99-1482.mis2
agtgaagtctgagggggaaaaatcaaccctatagagggaaggatctg

SEQ ID NO: 58 - DNA, 47 bp, Homo sapiens
  allele (1)..(47): polymorphic fragment 4-73, extracted from SEQ ID 1 (13657-13703)
  allele (24)..(24): polymorphic base C in PG1 (13680) in SEQ ID 1
  primer_bind (1)..(23): potential microsequencing oligo 4-73.mis1
  primer_bind (25)..(47): complement potential microsequencing oligo 4-73.mis2
gttttccttatgatgttacatggcttatttttaaaggtaatgaaaac

SEQ ID NO: 59 - DNA, 47 bp, Homo sapiens
  allele (1)..(47): polymorphic fragment 4-65, extracted from SEQ ID 1 (51448-51494)
  allele (24)..(24): polymorphic base T in PG1 (51471) SEQ ID 1
  primer_bind (1)..(23): potential microsequencing oligo 4-65.mis1
  primer_bind (25)..(47): complement potential microsequencing oligo 4-65.mis2
ggtgctgctcagcggcttgcacgtagacttgctaggaagaaatgcag

SEQ ID NO: 60 - DNA, 47 bp, Homo sapiens
  allele (1)..(47): polymorphic fragment 99-1482, variant version of SEQ ID 57
  allele (24)..(24): polymorphic base A; C in SEQ ID 57
  primer_bind (1)..(23): potential microsequencing oligo 99-1482.mis1
  primer_bind (25)..(47): complement potential microsequencing oligo 99-1482.mis2
agtgaagtctgagggggaaaaataaaccctatagagggaaggatctg

SEQ ID NO: 61 - DNA, 47 bp, Homo sapiens
  allele (1)..(47): polymorphic fragment 4-73, variant version of SEQ ID 58
  allele (24)..(24): polymorphic base G; C in SEQ ID 58
  primer_bind (1)..(23): potential microsequencing oligo 4-73.mis1
  primer_bind (25)..(47): complement potential microsequencing oligo 4-73.mis2
gttttccttatgatgttacatgggttatttttaaaggtaatgaaaac

SEQ ID NO: 62 - DNA, 47 bp, Homo sapiens
  allele (1)..(47): polymorphic fragment 4-65, variant version of SEQ ID 59
  allele (24)..(24): polymorphic base C; T in SEQ ID 59
  primer_bind (1)..(23): potential microsequencing oligo 4-65.mis1
  primer_bind (25)..(47): complement potential microsequencing oligo 4-65.mis2
ggtgctgctcagcggcttgcacgcagacttgctaggaagaaatgcag

SEQ ID NO: 63 - DNA, 21 bp, Homo sapiens
  misc_feature (1)..(21): upstream amplification primer 99-1482-PU
atcaaatcagtgaagtctgag

SEQ ID NO: 64 - DNA, 18 bp, Homo sapiens
  misc_feature (1)..(18): upstream amplification primer 4-73-PU, extracted from SEQ ID 1 (13547-13564)
atcgctggaacattctgg

SEQ ID NO: 65 - DNA, 20 bp, Homo sapiens
  misc_feature (1)..(20): upstream amplification primer 4-65-PU, extracted from SEQ ID 1 (51149-51168)
gatttaagctacgctattag

SEQ ID NO: 66 - DNA, 20 bp, Homo sapiens
  misc_feature (1)..(20): downstream amplification primer 99-1482-RP
acaaatctatataaggctgg

SEQ ID NO: 67 - DNA, 20 bp, Homo sapiens
  misc_feature (1)..(20): downstream amplification primer 4-73-RP, extracted from SEQ ID 1 (13962-13981) complement
ctcttggttaaacagcagtg

SEQ ID NO: 68 - DNA, 18 bp, Homo sapiens
  misc_feature (1)..(18): downstream amplification primer 4-65-RP, extracted from SEQ ID 1 (51482-51499) complement
tggctctgcatttcttcc

SEQ ID NO: 69 - DNA, 5226 bp, Homo sapiens
  CDS (31)..(717)
  misc_feature (5208)..(5208): n = a, c, g, or t.
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctctactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggtagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctatcgaaattctgtgtctccagcaggcaagaatacttgactaactctttttgtctctttatggtattttcagaataaagtctgacttgtgtttttgagattattggtgcctcattaattcagcaataaaggaaaatatgcatttcaaaaanaaaaaaaaaaaaaaaaaa

SEQ ID NO: 70 - protein, 228 aa, Homo sapiens
  misc_feature (5208)..(5208): n = a, c, g, or t.
MRYLLPSVVLLGTAPTYVLAWGVWRLLSAFLPARFYQALDDRLYCVYQSMVLFFFENYTGVQILLYGDLPKNKENIIYLANHQSTVDWIVADILAIRQNALGHVRYVLKEGLKWLPLYGCYFAQHGGIYVKRSAKFNEKEMRNKLQSYVDAGTPMYLVIFPEGTRYNPEQTKVLSASQAFAAQRGLAVLKHVLTPRIKATHVAFDCMKNYLDAIYDVTVVYEGKDDGG

SEQ ID NO: 71 - DNA, 158 bp, Homo sapiens
gccttgcagtattaaaacatgtgctaacaccacgaataaaggcaactcacgttgcttttgattgcatgaagaattatttagatgcaatttatgatgttacggtggtttatgaagggaaagacgatggagggtagcgaagagagtcaccgaccatgacg

SEQ ID NO: 72 - DNA, 1381 bp, Mus musculus
  CDS (45)..(1109)
  misc_binding (608)..(629): amplification primer g34292.pu
  misc_binding (740)..(758): amplification primer g34292.rp
  misc_feature (1244)..(1244): n = a, c, g, or t.
  misc_feature (1246)..(1247): n = a, c, g, or t.
  misc_feature (1249)..(1249): n = a, c, g, or t.
  misc_feature (1251)..(1260): n = a, c, g, or t.
  misc_feature (1262)..(1262): n = a, c, g, or t.
  misc_feature (1264)..(1264): n = a, c, g, or t.
  misc_feature (1267)..(1268): n = a, c, g, or t.
  misc_feature (1270)..(1270): n = a, c, g, or t.
gagccgagaggatgctgctgtccctggtgctccacacgtactctatgcgctacctgctccccagcgtcctgttgctgggctcggcgcccacctacctgctggcctggacgctgtggcgggtgctctccgcgctgatgcccgcccgcctgtaccagcgcgtggacgaccggctttactgcgtctaccagaacatggtgctcttcttcttcgagaactacaccggggtccagatattgctatatggagatttgccaaaaaataaagaaaatgtaatatatctagcgaatcatcaaagcacagttgactggattgttgcggacatgctggctgccagacaggatgccctaggacatgtgcgctacgtactgaaagacaagttaaaatggcttccgctgtatgggttctactttgctcagcatggaggaatttatgtaaaacgaagtgccaaatttaatgataaagaaatgagaagcaagctgcagagctatgtgaacgcaggaacaccgatgtatcttgtgattttcccagagggaacaaggtataatgcaacatacacaaaactcctttcagccagtcaggcatttgctgctcagcggggccttgcagtattaaaacacgtactgacaccaagaataaaggccactcacgttgcttttgattctatgaagagtcatttagatgcaatttatgatgtcacagtggtttatgaagggaatgagaaaggttcaggaaaatactcaaatccaccatccatgactgagtttctctgcaaacagtgcccaaaacttcatattcactttgatcgtatagacagaaatgaagttccagaggaacaagaacacatgaaaaagtggcttcatgagcgctttgagataaaagataggttgctcatagagttctatgattcaccagatccagaaagaagaaacaaatttcctgggaaaagtgttcattccagactaagtgtgaagaagactttaccttcagtgttgatcttggggagtttgactgcggtcatgctgatgacggagtccggaaggaaactgtacatgggcacctggttgtatggaaccctccttggctgcctgtggtttgttattaaagcataagcaagtagcaggctgcagtcacagtctcttattgatggctacacattgtatcacattgtttcctgaattaaataaggagttttcttgttgttgttttttttgttttgttttgttctgttttaagccttgatgatngnncncnnnnnnnnnncnantcnngngaccacagccaacatgcatttgatttggggcaaacacatgtggcttttcaggtgctggggttgctggagacatggaagctaagtggagtttatgctgtttttttttttttt

SEQ ID NO: 73 - DNA, 15766 bp, Mus musculus
  misc_feature (52)..(121): exon 2
  misc_feature (353)..(362): n = a, c, g, or t.
  misc_feature (682)..(797): exon 3
  misc_feature (1600)..(1600): n = a, c, g, or t.
  misc_feature (2628)..(2717): exon 4
  misc_feature (4748)..(4748): n = a, c, g, or t.
  misc_feature (4791)..(4791): n = a, c, g, or t.
  misc_feature (5587)..(5587): n = a, c, g, or t.
  misc_feature (5648)..(5648): n = a, c, g, or t.
  misc_feature (5716)..(5716): n = a, c, g, or t.
  misc_feature (5842)..(5842): n = a, c, g, or t.
  misc_feature (5850)..(5850): n = a, c, g, or t.
  misc_feature (5878)..(5878): n = a, c, g, or t.
  misc_feature (7591)..(7591): n = a, c, g, or t.
  misc_feature (7834)..(7924): exon 5
  misc_feature (8183)..(8183): n = a, c, g, or t.
  misc_feature (8273)..(8273): n = a, c, g, or t.
  misc_feature (9116)..(9116): n = a, c, g, or t.
  misc_feature (9804)..(9965): exon 6
  misc_feature (10166)..(10166): n = a, c, g, or t.
  misc_feature (10176)..(10176): n = a, c, g, or t.
  misc_feature (11404)..(11527): exon 7
  misc_feature (12292)..(12292): n = a, c, g, or t.
  misc_feature (12296)..(12296): n = a, c, g, or t.
  misc_feature (12299)..(12300): n = a, c, g, or t.
  misc_feature (13252)..(13252): n = a, c, g, or t.
  misc_feature (13539)..(14035): exon 8
  misc_feature (13762)..(13764): stop codon
  polyA_signal (13835)..(13839): AATAAA potential
  misc_feature (14022)..(14022): n = a, c, g, or t.
  misc_feature (14038)..(14038): n = a, c, g, or t.
ttttttttttttaattgtcaaagtcatgattctttttgttttctcttttagatattgctatatggagatttgccaaaaaataaagaaaatgtaatatatctagcgaatcatcaaagcacaggtttgtatttcatttgatgaaatttgggtttttctagaaatggtaaatgagcattaatatgtacacacacatacacacaaacacacatatgtacacacacatatgttttaaagacaggatttcatgtgacccagaatggcctcatactctctgagtagctgagaatgattttaagcttgtgacacacctgccttcatctccaaggtacaggaattgcaggtgctttctttgnnnnnnnnnntttttttttttgagttttggggagggggtatattttttaatgtgtctgtagttggctttgttttaagcattttaatcatactttatttttaaaaaaactaaaagcttttttaaggctaggtcttgctatgtggccctagtgttcctgggacttgctctgtacaccgggttgactctgagcctgtgcgccttctgcctctgcctccatagttagattctcaggacatgttacaaagactgtgctgtgaagatgagtttttgttcctgggagggaaggttggagctgacttgtgaggtactgacttgggtctgccttacagttgactggattgttgcggacatgctggctgccagacaggatgccctaggacatgtgcgctacgtactgaaagacaagttaaaatggcttccgctgtatgggttctactttgctcaggtaaactttgtctttgcccttttatttcaaacttaacaccatttaatgaaactatatctgatttttttgtttatgtgtttgttttatggtacccgtgattgaacatggggtcatatgtgtgctactgagtgacagccttagttcagacattttttaaagcgacttttactagtatttttatttagaattctatatgtgtgcacatgcatatgtgtgcttgtgtgcacacgtggatgcatgtgaggtcgaaggacaattttcagtacaagtgtgagtgtcactttttaggcaccttccactcttattttgagacagtctcctagacctttgctgagttgcccaggctagccggccagtgagccctgggcatctaccggtctctgcctccttacctttacttaggttacaagtgtgtgctgctacgcccagctgtttactagattctagggatccaaatgtgggtcctcgtaacttgtgagacaagtactttccaaactgagccacctccctagctcttcttcacggttcctgatggtgtgtgtctagatggctggttgtccgtatatttaagtccagtagcagaaatacaaatacctaggagtccaatagaaagctacaagtgcagaattgacaatcggtaatgttcggaaattgattcaaaagtagttagtgagtgacagacaggagctaaaagcagactctgagctcagagtgtgaagtgtggagaaatgtgttttctcacagttctgaaggctgaaagtctccccaaggtcaggatgtgggtggtactgctgtctcccaancacccacctctttggattatagactgcagccttctccctgtgttctgagccggcctttcccacatgtggacatccttggtgggtgttccaccagcagggcctcagctagtgcccttatttcacttaactgtaatgattttcttaaagaccctgtctccatacacagtcactgtggaagctgaagcttcaatgtaagagttaaggggggagggggaaatttagtccataatggtgtcacaccaatctctgtagctgagtccatgattcagttctttaaaggctctgagtgtagacattatcttaattattttgcccatttatgtattatctttaatttattttatgtaactgaatgcctgtgtatatatgtttctggttcctagtccatattttaattccttaaaggatggaggtgtagacttttgtctttttaattttctatccttccctcctggcctcctgtggcctcttttacgtatttattatttttaatttattttatgtgtttgagtgttttgtatctatgcattcctggggcccatggaggtcagaaaaacacattaggtggcctacaactgagttatgggtggtttgtgaccatggggtgctgggacttgatcaccagtctctgagaagactcgtgtctgctgagccttctctccagtcctgggagtgtggatattttaaggatacttttaattgacttggtgaatgacagtagaaaatcaatgagttaggatccatcggaaaaagcttttgaactaaatcttttaaagagaaaatattttaagtgctaacaaaattaaatgtgtattttccatgatgcagttttacttgggctctgtagaaataggattttcaggtacatattgtatatatagttggcaatatttaaatactaactgtcgcttgagttctgaaatgtagttttatgttttttactcattaggagtacagttgccttaataactacggagattagttattaaagaataattgctcttcttttttcttttctgtgtaccagcatggaggaatttatgtaaaacgaagtgccaaatttaatgataaagaaatgagaagcaagctgcagagctatgtgaacgcaggaacaccggtaagtgcgcccgcttttattcctcaaggcaggttaagaagttaagttcttaagtcattttgaaaatatattaccccatgtggagcaatggaactggttcggggttttgttgagataagctgtcctctggccgtgaggtaagattgctgcaggtgattgtaaggtttctcctgagtaacagtcagcatgggctcgggacgggcaagggcaggccttagtgtgcagaggatggagctcactgaagccccaaagagttagtcttcacatgagattcagttctagaagaagttaaattgctttctttctgtgtaaatttggatttttattgtagaaattaaagtttgttttcttttaaaacaaacacaaacccagagcaaagagtctcctagtgaagagtcattccgtgtcagtattttacacaactgtttttctgtaaagggggaaaaagaattcaaatcttctctttcaagaatgctgactgctgccaactgcctctccccgtggcccctctctgtatagacaggcatagctatggtgaggacttgggcggctcttgtctttctcctctctctgcttctctaccctttctctcgtgccctccacttaccaggccctgggaagctacacaccaggcaacagtgaccagggcctcggcctgggcttcgaccaattactagagcagaaacagcagcagctgcagtgttgttttgtgctgtgcactgtattaggttgtgttttcatcacctttgggttttgtgatgttttgatgaagtcctggtaccattctagtttttacattctgggtagatagagtttattcaaggtctcaaggcatatgaatggaagagctcctctttacagccattcgtgtagcatgcataactgctcttctgtattctctctagtgtctttttttttgtgtgtgaatctgatgtcttgttattcacctacaatgtggagtaatggtcataaacatataaagtacttatgcctttatctgccaaattgtatttaacttttcagcttttaatataactttttatataataattaatttattttaaaaaaaattgaataccagcctgttatagtggcatatgcctgtgttcctagcactcaggagacaaaggcagaagtgtgagaacttcagactcatactcagctatatacaagaccccaaatttgtgctagattctgcagtacagccatgagtgtccccatcttagagggagatcgctcatccttgtgctgttctttaagtcttaccctgcaacccactgtaagtacactcttgctcacagtcctttagaatctcacactctttctctttacagacaccatgtcattgcccactttattatttatctgatgtctacaaagattatgaaagagaaacttgtatgcattctgtgtaaagtacttgacacaaataatagtattcaagaatgacttcttaaatgaacactgaatgaatagtttgttctaatttttttgatcaacaaatcaaaaaatatttagattaaatatctaagatacaaagcataataccacatgaatcattaaagtgagtaatcaatcttataagtgactgaccctaaaactcatagacattaataattgctttcattgcttagatataaactttattgattaatacgttctcatgaaagtggttcttggaaggttctggaaacgaaaatatttttcttactgcttttttcttctagtaactgattgaatttttctgcagttccataaagcatctggtcaattgctattatccaatatgaggatatataacaaagtattgatttttaaatttggcggtgataagacaagactgggcgtgtgaatgagggggtctctgtttcttgtcccttctcttgggttcttttccttttgttggtttgccttctccagctgctatgtgatgggttctgattatcttattatatcttattttgttatttttcattgttatctcttagaagccaacatgttatatcacctccactcccaccattaggtgtnctcacaaataccccaagctaaacaaccacatcatgtcatgttnctgtatacttccataagtgttgttaactctactgactcttgtgagcaggcccaattggctttatccctagctgggtgacctgggttcctccccaacaccataccgtccatcaaactgagtccttttccaagcacacaccagatactgctcatctgaggactcttctcatccacctaaggactgcctgctcctcggcagaaagggcctctagtcccatacccttacgccctcaccaatgccttaggaacatgtgctcaatgcccctgtgggtcatttccgtttacagtagggaaatttgcctgataacttgcagcacacctataaagaggccttgcttgctctcatatttagctggagaagataatgtactcaccaactccactctatgcaacccagtctgctctgcccatgccagtcagacgtgaatcttacacctggattcagattgatgaatctacaacatcacccactccatgcttccttctaaatcagcagttctagcctgaatgacagatgctacccaagtctcatctagttagccctgtccggagtaaccctgaccttgaggattagaccaggatgcacatcctgcaccagttccctttgtccacctgacttcatcccacccgggccatagcccatgctcaggctccaccctccatgcacaaagctggcttttccagcttccttcacctgtatcagacacaaatagcaaaaggggtccacgtgcctaggtcccatcacaagaccatgtgcggtagtttggaaaacagtctccacttgaggctcagatagnttggaatcttggctctcatgtagttgtactgattagatcagtttaggaagtatgacctttntggaaagaacatataactgggaggggctttgagatgtaaaggccccacacaattcctagttcaaactntactgcctgctcaaagcttgaggcatgaactctcactgttcctgatgtcatggttcctgtctgcttccacaattccctatcattaggggtccctttccttcctggaattttaagtataaataaacncttctttntaaaacaacaagaacaacaaatctgacnctgataatggattttaaggcgtcttctctggataagaaaaaaaaaagaatatatttgcataggtgctgtattacttttgtcattggtataacctgactggaagcaacttaaaggaagaagaatgtatcttgatttgtagattaagagcaccatgactaagaaggcatagcagcacaggtgcaccagcaagaacataggctgctagctcagatctctgtagatatgggaacagggcaggaagctagtagtctataaacctcaggacccatcccatggagttccttgtcttccagtgatgtcctgtgtcttaaagtttcacagttcccacagcagcacctgccgtctgggaaccaacctgtggtggatattttacaacgtgataggcatattttgtctctagccctgtaggtttatagccatcctatacttcagtttatctagtccacctcagtctgatggtcttatagttccaacacttcaaaactacaaagtcttaagggccatgggctcgggtttattagagcagtaacacctctactagctttctgtgttacccactcctcttaaggtctggttgaaatcctaataggaagcagcttgagaggagggtttattgtggcccatactttgttggtacattctatcatgcaagggtggcactgtgatacagccgaggccatccgaggatggtactgttggcttacatctgggtgggacaggaaatggtaattctcaaggcccacctgcttggtgacttctttcagttaagccccatactctaaatcctctacaacctcccaacataatgccaccagctggggatcagctgttgacagtgctggcccaggggagcagtttaaatccagaccaggggacctgaaaacagagaactgcagaggggctgtgggactttataccagctttgcagacaaatcacggcatttctttgtgagcttggttcataaacaaatatatattctcctataggctcctttagtgggtgtttcatatccacaaatttgttcagaaaaacactgtgttttatgctagctgtgtaggagataataccgctgggagtcacttgagcatggataagtgacatagttcgtcctcatgagtccctgtcctgtttctgtattatgtttacttgatgagtttagtttgtcagttggccaccaattaaaaagtatcattttattttttttacaatactcagttctcaagttaggagttttgttattatatggcttcaatattcacattttaacctttccaggagttaagtataaaaacttatatcaactgttgacttagtaaatatctattacagatactatattcttcttagtttatatcatgaatatgaggttgcttaaagtaagtgatgtaaaatacactaggggatgcttataaaatggaatgttgtgagttttttgaaacacgagtactaaattcataagtttttaaatagttacactgttagcttcagtactgctagatacatgtctataatggctgaagagtggagcttggatattataagtgtactctgtatattcatgcagacatatagcagattccactagtatgtgtggttaatatgtgctaataaaaatttaatacaaaagtcatgttttattactgggaaccagaggggttggttgtgctgattttaagtcagtgactattagcatattctaagaaacagttttnaggattttaaagattggctttaccataaatgtagagctatgttttactataatccatattatggtcggccttaattcaatctctgcagtttggttactctgctcaaagtgaaggtcatttataaatgatacacattttctcaccataggaaatactacctggccaataacagagttagaattgctaaattgatggtaccaacaatggactcaacacaaactaaagtttatttatgcccacagatgtatcttgtgattttcccagagggaacaaggtataatgcaacatacacaaaactcctttcagccagtcaggcatttgctgctcagcggggtaagtaaagatttaactgtattcagaaaaacacttttttaagaagagtgatctttgtttccttcagagtcatactaaagaatatgcgtttcttgtaagagctaagtgagagaatatccgatcttctacagagttaggtatattcttattagtctgtgtctgagaggttagagacgcaggcttgctatggcacatttcccatgctgtgaattgagttaaaaatgtaggtaaatgatatccccaagaaagtatacttttnggagtgactcagtataaagcctggtgttataacataaacacgcacgtgcggatgtatatgtagcacatatgtaaacacaggtatatgcanttgtaataagaaagtggaggtcggggcccactgcaggcaagtcttttagtgatgctgagctaatgctgagaggtagaaagaccaagaaggctggagttgctcattcggcaaaggtcagagctcactgtgtgccataactcgagtgttctgtctcccttttgatacagttttcttgtttttaattattagtttttacaattatcccataaaatgtgggctcattgtggtcatcgttttcataaagtccttcaagtatacacccagcaagtatctaaatacactgggaagaatcagtcagctgatggcttgaagtttcaggacatctagtgccacatcatgcttcagaaccgacctgcacttagtcagggtcatattcatgccacgtgaagacgagaggaggccatgccgtctgacttaggatggaaatttccttcgagcaaacacgaacgggctaggtcttagttataggcatagtgtctgtggttatactaggcagacattagtggactgggtgttagaaggtacagacaggcaagaatttgctgtagatttgtttccctcatgtgttgacaccacatctaacctgctttttgagcttctagtcctaataatctcataaaaatactggttgaaccagaaatggtgttgcaaagctatgatcccagctcctgggatctagggtgggaggatcataaatttgaggccagcttgggtctgtcttagagaaaaaagaaaaataaaaagtctggtcaaggtaacatggagcctggaagtttcacagggtgattctgtaaaggtcctgagacaagatggcctctagtggcgaatgacttagctgacaangaaaactttcccagcttggttgacttttcagacttcatacaagtttgtgaataaattacactccttctgcccttgggactgaactcagatatgtggttgtgggaatggctttctttcccacaccaccctgcattttaaaaattcttctgtagacagtcccaccatcctgtagctgttcttccttatgtcgccactttccctggagagaggcagtgcagacttcaacccgcttctccctagtcgctgttcatagcacatcgaaagacctagtgcttcctgtgaaattgtaagtacatcctggagtccaggagaggaggaagccgaacagagtggagggaatgctgagttctgtcctaagaaagactgcgtgcttagcaagatgctgctgctctcctgtcgtgtctttcttgtcagaacttatcaaagagaaggctcgcagtgggtcataatcttcccaaggaccagccttcccagcttctcgcagcatatctcattcatgtagatgtttaatggatatgtgtcaatggggttgacctaagtgagatggcaatgtatgtgagcattctaggtgtgaggttatggcattaaactttaatttccgtctatttgtggtagttgataagtaatttagatgttgactttcatgtattcctaattatgaccacattgaatctacctgctttctaggccttgcagtattaaaacacgtactgacaccaagaataaaggccactcacgttgcttttgattctatgaagagtcatttagatgcaatttatgatgtcacagtggtttatgaagggaatgagaaaggttcaggaaaatactcaaatccaccatccatgactggtaagtccgtatttccatagaagctgaatagtacatggtacaggtaagataaactcttgtttgttcgctttgcttagcttggttcagtttggttttcagtagagggttccactatgaagctctggctggccgggaactcactatgtagaccaagctggccttgggctccactacacccagcaccaatcacccactcttatncttttatgcntttttgtttttgctttgagctttctttataacatgtttgggaaggacattgtcattatttacaagaagaaatatggtcttttcccaacatgctagaatttaaagactcagaactcttgcctttgtcagtgacaaagtgagaatggctgtgaagtgacgtggctttgagtgagaatagttcaggtaactatagccacagactcaacatttgaacatgggaacaggtgagaacggagtgatggaagattctggcccctttcagagaattcattttagagagagatgagagtagtaaggaagagagaagagagagacgtggtattttgctgcagactaaagagatctcttataatcgcagtactaaggaggaagaagcagaagatgatgactacagggccaggctgaacaatctagtaaaatcctaagtcaggaagtcagggctgaggtgcagctcagtaggagagttgttgtctgccctacacaaggcctggatttagctcccagtagcaacgaagggaggcgagggtgggcaaaatcgaacacttactcttggagactccctttatgaatattaccacactccagtaaatactctccagagatttcagatgagattctgcttcctggtaaacaggaggccaagaatattatgtcacactgaacatgggatggaagacatgttctgaggaatgtctgcactccagtgtgatgaagacttgaagtttagggacattttccctccctggccccactcaccccatctgtattgagtattcccctagtgctcatctttatttgtatgttaactttcaggaaggggaagcagattgatattcaaacccagccagttttcttaaatactttgtggatgggattggctttgacagtaaatgaggaaatgtaaaatgtaaaagattctaatttttaatattttaaaggtgaggttttctgttagtacgcagagtgagaggtttcttactgatgtctgcgtacctagaggaaggatggctacttctccaaggcttgctgttagaagtcagtgacatgggcttaacaagagatatgtgctaatgaggttttaatttcagcttaatactgcaaatcataagtgcatagctttattgttttaaattcttttagtcttaatgtttcatttttaccataagttactttgtataatcacaaattctaaactagtaagacgtgaaattttcttcttctttgttagagtttctctgcaaacagtgcccaaaacttcatattcactttgatcgtatagacagaaatgaagttccagaggaacaagaacacatgaaaaagtggcttcatgagcgctttgagataaaagataggtaagtggtaagagctccagcatttagaaagtgcagttcaaccaaattttactctcagatcctgcttgaaaggagtctttttatcttcattatttagtaaatactaatcatacctgcatagacaagaccacatatacttaaatgtagcatgtttcatggtgcgttacccttgtttaacaattaagtttaacatcctacatcagtttgcctgttgatttctgtaccatgacaactcaacacagcgatgcgtttattccaaagtcgatagcacagcaaaagtgaaactaaagtctgtattgtttcaagaatgctttttgtgaactcgggttaaatcttattctatcctttcgtgttcacattgtacattttcatgagtcactataaaaatcatgacatggtggcctacctgcagtgtttgctggacagtaggctgctgtgtgataagagcctttcctcttcagctacacgggggacacgaggctttggggttcaagactgaagcacgggtgagcacaacacctttgtgttgtgggaaggaagggaattgttcttttcataatgaaattgtcccctttcttgagttagtagaaagtattacaaggatagagagttgaaatgaagctttatattagatttatgccttgtgttgtcacgtgtttctacctgacataacttttcaacccagccgctcaggattattttgatgatgggaacaatgtaagaaggcctatgtatcggtaactcactgttgtagctctgtggaancggntcnncaggcagtagggacgcttctgtgcttttgtgcctgtcctgctgttagaatcttacagaggaggatgaatgaatgaccctttttatttctcttgtctgcttttctaattttatgggaataagaacttttggtaggtctctgtcactggcctcttgttgtgaagagacaccttgagcaaagcaactcttctgagagaaagcatttagttggggaattccttacagcttcagaggttgagttcgttttcatcatgctgaggacagggaggcactcaggcaggagaagtagttgagagccacattctgatctacaggcagagagagacagactgagcctggcatgggttcttggaacctcaaagcctctcatccctaccccatctcccgacccctatacacacttcctccaacaaggctacaccttctaatccttcttaaagagtcaccacatccagcgactaagcattcagatatgtgaacctgtcggagcctttcttactcagatcacctcaggaggaaaactcctatgctataagaatttcttttctttcgcatctttgaaagcttgtttttgtgtgattagatcctggcctcacacatgctcggcaatcattttactgttgagctccagcctcagccgttttcattggcttatgggatgcgagccatgggagagaagctagaaggcctttcgttttatgagtcgggttggtggaaccacttacagatggaagatttacaaacaaaaatgaagctggggccatcaaggctcagcactcgctgctcttccagagagttcaggttcatttctcagtaaccacatggtggctttgtaaatgtaacttcatattcaatgaccctgacaccctcttctggcctctgtgggcaccagacacaatcatggtatacagacacacacactagccaacacccatctacataaaagtatataanacatatctttatcttaaaaatccccgaagtcctcattaaatatcttagatccccgccgtgttttgatttttgtttcccacgtggtgaggatataatatcatgtccaaactgtaaggagtgaatgccctcccgtgcctctcggacacctctgcactcatccaagttttctaaggagctgtacttgctcagcaagtactcaatacctaataaatggtttatgtttgtttcaacaccaaaaatgtccaaaactgaaagatcaattctgttgttttccttctggccataggttgctcatagagttctatgattcaccagatccagaaagaagaaacaaatttcctgggaaaagtgttcattccagactaagtgtgaagaagactttaccttcagtgttgatcttggggagtttgactgcggtcatgctgatgacggagtccggaaggaaactgtacatgggcacctggttgtatggaaccctccttggctgcctgtggtttgttattaaagcataagcaagtagcaggctgcagtcacagtctcttattgatggctacacattgtatcacattgtttcctgaattaaataaggagttttcttgttgttgttttttttgttttgttttgttctgttttaagccttgatgattgaacactggataaagtagagtttgtgaccacagccaacatgcatttgatttggggcaaacacatgtggcttttcaggtgctggggttgctggagacatggaagctaagtggagtttatgctgntttttttttttttttnaatgttttcatgaattaatgtccacttgtaaagattattggatactttctgtaattcagaaggttgtattttaacactagtttgcagtatgtttcgctatattggttatcttccatttgactacttggcagctcagactcttaatactaaagtattttacattttgaagctatgtgatactggttttttgttgttgttgttgttgttaatttctgaaagtcaatgaaagacactgtaatgatgcgttaagatgttccaagaaaaaggtgagaattattcatggcaaaaaagatctgtctagtgtatatttttattatattgctctatttagctaattttctttatatttgcaaaataatgaacatttttaatatttattaaaatgcttgatttgcatacccccgattctacagagaataatgtgtaaagtgtcagaatagacttgaagctctgctgtgactcagtctcctttgtcagagcttctagtagcccagctactgagctgctttgttagtacctccagcacctgagccgttaagtacttataaatgcaagggacccgttatcttcatatcggaatagacatgaacagagctctaaggcgatgaaagtctgccagcatcctctctgtcctcgcacgtgccttctgcctggctccatttgctttggcactgcgttcgatctagagtgtaggtgctcactgcttatttcagccctggctctgtggttttgtgtcctccagtggtgctgttcactgttggggtgcaggtggtgctgccctgactcagaggggcagctccctggctcctgagggtgagccttcttggctactacagaagtattgtgcgtttgtgtatggcaagaaccatcaggattggataaatgtgttatttctctttgatttccatggagccacactgttggtacatgtcccctgtgaacagagctacctttcaggagcacatcatactgtcgtgagtcacggcacggtgtgtcctgtgagaagaggctttctaacgtgtgatttgccgtgtttctatgttgtgatttaagcgtgattgcctactagtcattcaaggtaacatttctgcaaatttcatacagatttttgtcacaaaattactataccaatgatctagttgaaatagaccaattgaatcacaataaataattttttttaattgagggaaaatttgcttcttgttttttcaaagccagaaaacgagccatttcaaacatctttgaagagtcatgtgctgtcacttgttttctatgtgttagtgtctatattcatgtatggatacacatgaacatgtatattcatacacacacgccaatagaatataacagcctaaaaacaatccagcttgtgtatcatgttactgtgctgaattgtaatggtttttacttacaaagtgaggctaaaatcgatttcatgtctttgttaaatacgtttttttcagcaatcctattagagcttattttgaccagatcaaaataagtacaagttcagagactttaaatatggctgaggtctagagcgatagctcagtagttaggaacacatgccactctttcaagggcttcagttcccagcactcatatggaggctcacagaaggctggaattccagcttcatggaattggacacatcctctagcttccatggatctgtctgtctgtctctcccttctctctctctctctctctctctctctctctctctct

SEQ ID NO: 74 - protein, 354 aa, Mus musculus
MRYLLPSVLLLGSAPTYLLAWTLWRVLSALMPARLYQRVDDRLYCVYQNMVLFFFENYTGVQILLYGDLPKNKENVIYLANHQSTVDWIVADMLAARQDALGHVRYVLKDKLKWLPLYGFYFAQHGGIYVKRSAKFNDKEMRSKLQSYVNAGTPMYLVIFPEGTRYNATYTKLLSASQAFAAQRGLAVLKHVLTPRIKATHVAFDSMKSHLDAIYDVTVVYEGNEKGSGKYSNPPSMTEFLCKQCPKLHIHFDRIDRNEVPEEQEHMKKWLHERFEIKDRLLIEFYDSPDPERRNKFPGKSVHSRLSVKKTLPSVLILGSLTAVMLMTESGRKLYMGTWLYGTLLGCLWFVIKA

SEQ ID NO: 75 - DNA, 22 bp, Mus musculus
  misc_feature (1)..(22): amplification oligonucleotide g34292.pu
attaaaacacgtactgacacca

SEQ ID NO: 76 - DNA, 19 bp, Mus musculus
  misc_feature (1)..(19): amplification oligonucleotide g34292.rp
agtcatggatggtggattt

SEQ ID NO: 77 - DNA, 26 bp, Homo sapiens
  misc_feature (1)..(26): amplification oligonucleotide BOXIed
aatcatcaaagcacagttgactggat

SEQ ID NO: 78 - DNA, 33 bp, Homo sapiens
  misc_feature (1)..(33): amplification oligonucleotide BOXIIIer
ataaaccaccgtaacatcataaattgcatctaa

SEQ ID NO: 79 - DNA, 22 bp, Mus musculus
  misc_feature (1)..(22): sequencing oligonucleotide moPGrace3S473
gagataaaagataggttgctca

SEQ ID NO: 80 - DNA, 19 bp, Mus musculus
  misc_feature (1)..(19): sequencing oligonucleotide moPGrace3S526
aagaaacaaatttcctggg

SEQ ID NO: 81 - DNA, 18 bp, Mus musculus
  misc_feature (1)..(18): sequencing oligonucleotide moPGrace3S597
tcttggggagtttgactg

SEQ ID NO: 82 - DNA, 18 bp, Mus musculus
  misc_feature (1)..(18): sequencing oligonucleotide moPGrace5R323
gaccccggtgtagttctc

SEQ ID NO: 83 - DNA, 17 bp, Mus musculus
  misc_feature (1)..(17): sequencing oligonucleotide moPGrace5R372
cagtaaagccggtcgtc

SEQ ID NO: 84 - DNA, 17 bp, Mus musculus
  misc_feature (1)..(17): sequencing oligonucleotide moPGrace5R444
caggccagcaggtaggt

SEQ ID NO: 85 - DNA, 19 bp, Mus musculus
  misc_feature (1)..(19): sequencing oligonucleotide moPGrace5R492
agcaggtagcgcatagagt

SEQ ID NO: 86 - DNA, 27 bp, Mus musculus
  misc_feature (1)..(27): amplification oligonucleotide moPG13LR2
ggaaacaatgtgatacaatgtgtagcc

SEQ ID NO: 87 - DNA, 18 bp, Mus musculus
  misc_feature (1)..(18): amplification oligonucleotide moPG15
tggcgagccgagaggatg

SEQ ID NO: 88 - DNA, 36 bp, Mus musculus
  misc_feature (1)..(36): amplification oligonucleotide moPG15Bam1
cgtggatccggaaacaatgtgatacaatgtgtagcc

SEQ ID NO: 89 - DNA, 27 bp, Mus musculus
  misc_feature (1)..(27): amplification oligonucleotide moPG15Eco1
cgtgaattctggcgagccgagaggatg

SEQ ID NO: 90 - DNA, 20 bp, Mus musculus
  misc_feature (1)..(20): amplification oligonucleotide moPG1RACE3.18
ctgccagacaggatgcccta

SEQ ID NO: 91 - DNA, 23 bp, Mus musculus
  misc_feature (1)..(23): amplification oligonucleotide moPG1RACE3.63
acaagttaaaatggcttccgctg

SEQ ID NO: 92 - DNA, 18 bp, Mus musculus
  misc_feature (1)..(18): sequencing oligonucleotide moPG1RACE3R94
caaatgcatgttggctgt

SEQ ID NO: 93 - DNA, 20 bp, Mus musculus
  misc_feature (1)..(20): amplification oligonucleotide moPG1RACE5.276
gcaaatgcctgactggctga

SEQ ID NO: 94 - DNA, 22 bp, Mus musculus
  misc_feature (1)..(22): amplification oligonucleotide moPG1RACE5.350
aatcaaaagcaacgtgagtggc

SEQ ID NO: 95 - DNA, 20 bp, Mus musculus
  misc_feature (1)..(20): amplification oligonucleotide moPG3RACE2
tgggcacctggttgtatgga

SEQ ID NO: 96 - DNA, 20 bp, Mus musculus
  misc_feature (1)..(20): amplification oligonucleotide moPG3RACE2n
tccttggctgcctgtggttt

SEQ ID NO: 97 - DNA, 21 bp, Mus musculus
  misc_feature (1)..(21): sequencing oligonucleotide moPG3RACES20
gatggctacacattgtatcac

SEQ ID NO: 98 - DNA, 24 bp, Mus musculus
  misc_feature (1)..(24): sequencing oligonucleotide moPG3RACES5
tcctgaattaaataaggagttttc

SEQ ID NO: 99 - DNA, 24 bp, Mus musculus
  misc_feature (1)..(24): sequencing oligonucleotide moPG3RACES90
gtttgttattaaagcataagcaag

SEQ ID NO: 100 - DNA, 216 bp, Homo sapiens
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccag

SEQ ID NO: 101 - DNA, 70 bp, Homo sapiens
atattgctatatggagatttgccaaaaaataaagaaaatataatatatttagcaaatcatcaaagcacag

SEQ ID NO: 102 - DNA, 116 bp, Homo sapiens
ttgactggattgttgctgacatcttggccatcaggcagaatgcgctaggacatgtgcgctacgtgctgaaagaagggttaaaatggctgccattgtatgggtgttactttgctcag

SEQ ID NO: 103 - DNA, 90 bp, Homo sapiens
catggaggaatctatgtaaagcgcagtgccaaatttaacgagaaagagatgcgaaacaagttgcagagctacgtggacgcaggaactcca

SEQ ID NO: 104 - DNA, 91 bp, Homo sapiens
atgtatcttgtgatttttccagaaggtacaaggtataatccagagcaaacaaaagtcctttcagctagtcaggcatttgctgcccaacgtg

SEQ ID NO: 105 - DNA, 159 bp, Homo sapiens
gccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacgg

SEQ ID NO: 106 - DNA, 124 bp, Homo sapiens
aatttctctgcaaagaatgtccaaaaattcatattcacattgatcgtatcgacaaaaaagatgtcccagaagaacaagaacatatgagaagatggctgcatgaacgtttcgaaatcaaagataa

SEQ ID NO: 107 - DNA, 4342 bp, Homo sapiens
  polyA_signal (325)..(330): AATAAA potential
  polyA_signal (694)..(699): AATAAA potential
  polyA_signal (828)..(833): AATAAA potential
  polyA_signal (1821)..(1826): AATAAA potential
  polyA_signal (2480)..(2485): AATAAA potential
  polyA_signal (2800)..(2805): AATAAA potential
  polyA_signal (4264)..(4269): AATAAA potential
  polyA_signal (4315)..(4320): AATAAA
gatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 108 - DNA, 62 bp, Homo sapiens
agattggattcgtagattaaacttgagaaacaaaccataaaagtggaaggccctctttaaca

SEQ ID NO: 109 - DNA, 86 bp, Homo sapiens
gagatgggggtctcgctgtgttgcccaggctggtcttggactcaagcaatctgcctgtctcagcctaccaaaatgctggattatag

SEQ ID NO: 110 - DNA, 116 bp, Homo sapiens
gctaaagcagtcctcctgagtagttaggactacagacatacacgtgccaccgcgcccagctccgtgttctctttgtttccctgcctcctgctcttccacttatctttgcatggcag

SEQ ID NO: 111 - DNA, 45 bp, Homo sapiens
ggaaagacgatggagggcagcgaagagagtcaccgaccatgacgg

SEQ ID NO: 112 - DNA, 5138 bp, Homo sapiens
  CDS (31)..(264)
  polyA_signal (5111)..(5116): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 113 - DNA, 5224 bp, Homo sapiens
  CDS (31)..(264)
  polyA_signal (5197)..(5202): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccagttgactggattgttgctgacatcttggccatcaggcagaatgcgctaggacatgtgcgctacgtgctgaaagaagggttaaaatggctgccattgtatgggtgttactttgctcaggagatgggggtctcgctgtgttgcccaggctggtcttggactcaagcaatctgcctgtctcagcctaccaaaatgctggattatagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 114 - DNA, 4863 bp, Homo sapiens
  CDS (31)..(747)
  polyA_signal (4836)..(4841): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtgaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 115 - DNA, 5022 bp, Homo sapiens
  CDS (31)..(906)
  polyA_signal (4995)..(5000): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 116 - DNA, 4932 bp, Homo sapiens
  CDS (31)..(816)
  polyA_signal (4905)..(4910): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccagatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 117 - DNA, 4682 bp, Homo sapiens
  CDS (31)..(303)
  polyA_signal (4655)..(4660): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccagaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 118 - DNA, 4558 bp, Homo sapiens
  CDS (31)..(237)
  polyA_signal (4531)..(4536): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccaggatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 119 - DNA, 5270 bp, Homo sapiens
  CDS (31)..(231)
  polyA_signal (5243)..(5248): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccagagattggattcgtagattaaacttgagaaacaaaccataaaagtggaaggccctctttaacaatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 120 - DNA, 5002 bp, Homo sapiens
  CDS (31)..(324)
  polyA_signal (4975)..(4980): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccagatattgctatatggagatttgccaaaaaataaagaaaatataatatatttagcaaatcatcaaagcacagatgtatcttgtgatttttccagaaggtacaaggtataatccagagcaaacaaaagtcctttcagctagtcaggcatttgctgcccaacgtggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 121 - DNA, 4958 bp, Homo sapiens
  CDS (31)..(579)
  polyA_signal (4931)..(4936): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 122 - DNA, 5094 bp, Homo sapiens
  CDS (31)..(978)
  polyA_signal (5067)..(5072): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtgggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 123 - DNA, 5049 bp, Homo sapiens
  CDS (31)..(933)
  polyA_signal (5022)..(5027): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtgaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 124 - DNA, 5324 bp, Homo sapiens
  CDS (31)..(588)
  polyA_signal (5297)..(5302): AATAAA
ctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccagatattgctatatggagatttgccaaaaaataaagaaaatataatatatttagcaaatcatcaaagcacagttgactggattgttgctgacatcttggccatcaggcagaatgcgctaggacatgtgcgctacgtgctgaaagaagggttaaaatggctgccattgtatgggtgttactttgctcagcatggaggaatctatgtaaagcgcagtgccaaatttaacgagaaagagatgcgaaacaagttgcagagctacgtggacgcaggaactccaatgtatcttgtgatttttccagaaggtacaaggtataatccagagcaaacaaaagtcctttcagctagtcaggcatttgctgcccaacgtggctaaagcagtcctcctgagtagttaggactacagacatacacgtgccaccgcgcccagctccgtgttctctttgtttccctgcctcctgctcttccacttatctttgcatggcaggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacggaatttctctgcaaagaatgtccaaaaattcatattcacattgatcgtatcgacaaaaaagatgtcccagaagaacaagaacatatgagaagatggctgcatgaacgtttcgaaatcaaagataagatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaat

SEQ ID NO: 125 - protein, 77 aa, Homo sapiens
MRYLLPSVVLLGTAPTYVLAWGVWRLLSAFLPARFYQALDDRLYCVYQSMVLFFFENYTGVQLTGLLLTSWPSGRMR

SEQ ID NO: 126 - protein, 238 aa, Homo sapiens
  SITE (98)..(103): Box II
MRYLLPSVVLLGTAPTYVLAWGVWRLLSAFLPARFYQALDDRLYCVYQSMVLFFFENYTGVQHGGIYVKRSAKFNEKEMRNKLQSYVDAGTPMYLVIFPEGTRYNPEQTKVLSASQAFAAQREFLCKECPKIHIHIDRIDKKDVPEEQEHMRRWLHERFEIKDKMLIEFYESPDPERRKRFPGKSVNSKLSIKKTLPSMLILSGLTAGMLMTDAGRKLYVNTWIYGTLLGCLWVTIKA

SEQ ID NO: 127 - protein, 291 aa, Homo sapiens
  SITE (98)..(103): Box II
  SITE (149)..(157): Box III
MRYLLPSVVLLGTAPTYVLAWGVWRLLSAFLPARFYQALDDRLYCVYQSMVLFFFENYTGVQHGGIYVKRSAKFNEKEMRNKLQSYVDAGTPMYLVIFPEGTRYNPEQTKVLSASQAFAAQRGLAVLKHVLTPRIKATHVAFDCMKNYLDAIYDVTVVYEGKDDGGQRRESPTMTEFLCKECPKIHIHIDRIDKKDVPEEQEHMRRWLHERFEIKDKMLIEFYESPDPERRKRFPGKSVNSKLSIKKTLPSMLILSGLTAGMLMTDAGRKLYVNTWIYGTLLGCLWVTIKA

SEQ ID NO: 128 - protein, 261 aa, Homo sapiens
  SITE (68)..(73): Box II
  SITE (119)..(127): Box III
MRYLLPSVVLLGTAPTYVLAWGVWRLLSAFLPARFYQALDDRLYCVYQSMVLFFFENYTGVQMYLVIFPEGTRYNPEQTKVLSASQAFAAQRGLAVLKHVLTPRIKATHVAFDCMKNYLDAIYDVTVVYEGKDDGGQRRESPTMTEFLCKECPKIHIHIDRIDKKDVPEEQEHMRRWLHERFEIKDKMLIEFYESPDPERRKRFPGKSVNSKLSIKKTLPSMLILSGLTAGMLMTDAGRKLYVNTWIYGTLLGCLWVTIKA

SEQ ID NO: 129 - protein, 90 aa, Homo sapiens
MRYLLPSVVLLGTAPTYVLAWGVWRLLSAFLPARFYQALDDRLYCVYQSMVLFFFENYTGVQNFSAKNVQKFIFTLIVSTKKMSQKNKNI

SEQ ID NO: 130 - protein, 68 aa, Homo sapiens
MRYLLPSVVLLGTAPTYVLAWGVWRLLSAFLPARFYQALDDRLYCVYQSMVLFFFENYTGVQDAYRIL

SEQ ID NO: 131 - protein, 66 aa, Homo sapiens
MRYLLPSVVLLGTAPTYVLAWGVWRLLSAFLPARFYQALDDRLYCVYQSMVLFFFENYTGVQRLDS

SEQ ID NO: 132 - protein, 97 aa, Homo sapiens
  SITE (81)..(83): Box I
MRYLLPSVVLLGTAPTYVLAWGVWRLLSAFLPARFYQALDDRLYCVYQSMVLFFFENYTGVQILLYGDLPKNKENIIYLANHQSTDVSCDFSRRYKV

SEQ ID NO: 133 - protein, 182 aa, Homo sapiens
  SITE (81)..(83): Box I
MRYLLPSVVLLGTAPTYVLAWGVWRLLSAFLPARFYQALDDRLYCVYQSMVLFFFENYTGVQILLYGDLPKNKENIIYLANHQSTVDWIVADILAIRQNALGHVRYVLKEGLKWLPLYGCYFAQHGGIYVKRSAKFNEKEMRNKLQSYVDAGTPNFSAKNVQKFIFTLIVSTKKMSQKNKNI

SEQ ID NO: 134 - protein, 315 aa, Homo sapiens
  SITE (81)..(83): Box I
  SITE (160)..(165): Box II
MRYLLPSVVLLGTAPTYVLAWGVWRLLSAFLPARFYQALDDRLYCVYQSMVLFFFENYTGVQILLYGDLPKNKENIIYLANHQSTVDWIVADILAIRQNALGHVRYVLKEGLKWLPLYGCYFAQHGGIYVKRSAKFNEKEMRNKLQSYVDAGTPMYLVIFPEGTRYNPEQTKVLSASQAFAAQRGKDDGGQRRESPTMTEFLCKECPKIHIHIDRIDKKDVPEEQEHMRRWLHERFEIKDKMLIEFYESPDPERRKRFPGKSVNSKLSIKKTLPSMLILSGLTAGMLMTDAGRKLYVNTWIYGTLLGCLWVTIKA

SEQ ID NO: 135 - protein, 300 aa, Homo sapiens
  SITE (81)..(83): Box I
  SITE (160)..(165): Box II
MRYLLPSVVLLGTAPTYVLAWGVWRLLSAFLPARFYQALDDRLYCVYQSMVLFFFENYTGVQILLYGDLPKNKENIIYLANHQSTVDWIVADILAIRQNALGHVRYVLKEGLKWLPLYGCYFAQHGGIYVKRSAKFNEKEMRNKLQSYVDAGTPMYLVIFPEGTRYNPEQTKVLSASQAFAAQREFLCKECPKIHIHIDRIDKKDVPEEQEHMRRWLHERFEIKDKMLIEFYESPDPERRKRFPGKSVNSKLSIKKTLPSMLILSGLTAGMLMTDAGRKLYVNTWIYGTLLGCLWVTIKA

SEQ ID NO: 136 - protein, 185 aa, Homo sapiens
  SITE (81)..(83): Box I
  SITE (160)..(165): Box II
MRYLLPSVVLLGTAPTYVLAWGVWRLLSAFLPARFYQALDDRLYCVYQSMVLFFFENYTGVQILLYGDLPKNKENIIYLANHQSTVDWIVADILAIRQNALGHVRYVLKEGLKWLPLYGCYFAQHGGIYVKRSAKFNEKEMRNKLQSYVDAGTPMYLVIFPEGTRYNPEQTKVLSASQAFAAQRG

SEQ ID NO: 137 - DNA, 19 bp, Homo sapiens
  misc_feature (1)..(19): amplification oligonucleotide PG1ASe13
accggggtccagttgactg

SEQ ID NO: 138 - DNA, 17 bp, Homo sapiens
  misc_feature (1)..(17): amplification oligonucleotide PG1ASe14
cggggtccagcatggag

SEQ ID NO: 139 - DNA, 16 bp, Homo sapiens
  misc_feature (1)..(16): amplification oligonucleotide PG1ASe15
ccggggtccaggcctt

SEQ ID NO: 140 - DNA, 16 bp, Homo sapiens
  misc_feature (1)..(16): amplification oligonucleotide PG1ASe16
cggggtccaggccttg

SEQ ID NO: 141 - DNA, 21 bp, Homo sapiens
  misc_feature (1)..(21): amplification oligonucleotide PG1ASe17
accggggtccagaatttctct

SEQ ID NO: 142 - DNA, 19 bp, Homo sapiens
  misc_feature (1)..(19): amplification oligonucleotide PG1ASe18
cggggtccaggatgcttat

SEQ ID NO: 143 - DNA, 23 bp, Homo sapiens
  misc_feature (1)..(23): amplification oligonucleotide PG1ASe24
aatcatcaaagcacagcatggag

SEQ ID NO: 144 - DNA, 28 bp, Homo sapiens
  misc_feature (1)..(28): amplification oligonucleotide PG1ASe25
caaatcatcaaagcacagatgtatcttg

SEQ ID NO: 145 - DNA, 20 bp, Homo sapiens
  misc_feature (1)..(20): amplification oligonucleotide PG1ASe26
atcaaagcacaggccttgca

SEQ ID NO: 146 - DNA, 26 bp, Homo sapiens
  misc_feature (1)..(26): amplification oligonucleotide PG1ASe27
agcaaatcatcaaagcacagaatttc

SEQ ID NO: 147 - DNA, 28 bp, Homo sapiens
  misc_feature (1)..(28): amplification oligonucleotide PG1ASe28
atcatcaaagcacaggatgcttatagaa

SEQ ID NO: 148 - DNA, 31 bp, Homo sapiens
  misc_feature (1)..(31): amplification oligonucleotide PG1ASe35
gtgttactttgctcagatgtatcttgtgatt

SEQ ID NO: 149 - DNA, 23 bp, Homo sapiens
  misc_feature (1)..(23): amplification oligonucleotide PG1ASe36
tactttgctcaggccttgcagta

SEQ ID NO: 150 - DNA, 27 bp, Homo sapiens
  misc_feature (1)..(27): amplification oligonucleotide PG1ASe37
gggtgttactttgctcagaatttctct

SEQ ID NO: 151 - DNA, 29 bp, Homo sapiens
  misc_feature (1)..(29): amplification oligonucleotide PG1ASe38
ggtgttactttgctcaggatgcttataga

SEQ ID NO: 152 - DNA, 20 bp, Homo sapiens
  misc_feature (1)..(20): amplification oligonucleotide PG1ASe46
caggaactccagccttgcag

SEQ ID NO: 153 - DNA, 23 bp, Homo sapiens
  misc_feature (1)..(23): amplification oligonucleotide PG1ASe47
caggaactccaaatttctctgca

SEQ ID NO: 154 - DNA, 25 bp, Homo sapiens
  misc_feature (1)..(25): amplification oligonucleotide PG1ASe48
cgcaggaactccagatgcttataga

SEQ ID NO: 155 - DNA, 22 bp, Homo sapiens
  misc_feature (1)..(22): amplification oligonucleotide PG1ASe57
ctgcccaacgtgaatttctctg

SEQ ID NO: 156 - DNA, 22 bp, Homo sapiens
  misc_feature (1)..(22): amplification oligonucleotide PG1ASe58
gcccaacgtggatgcttataga

SEQ ID NO: 157 - DNA, 23 bp, Homo sapiens
  misc_feature (1)..(23): amplification oligonucleotide PG1ASe68
cgaccatgacgggatgcttatag

SEQ ID NO: 158 - DNA, 19 bp, Homo sapiens
  misc_feature (1)..(19): amplification oligonucleotide PG1ASe1X
ccggggtccagagattgga

SEQ ID NO: 159 - DNA, 26 bp, Homo sapiens
  misc_feature (1)..(26): amplification oligonucleotide PG1ASeX2
aaagtggaaggccctctttaacaata

SEQ ID NO: 160 - DNA, 25 bp, Homo sapiens
  misc_feature (1)..(25): amplification oligonucleotide PG1Ae1b3
gccctctttaacattgactggattg

SEQ ID NO: 161 - DNA, 24 bp, Homo sapiens
  misc_feature (1)..(24): amplification oligonucleotide PG1Ae1b4
gccctctttaacacatggaggaat

SEQ ID NO: 162 - DNA, 28 bp, Homo sapiens
  misc_feature (1)..(28): amplification oligonucleotide PG1Ae1b5
ggccctctttaacaatgtatcttgtgat

SEQ ID NO: 163 - DNA, 25 bp, Homo sapiens
  misc_feature (1)..(25): amplification oligonucleotide PG1Ae1b6
gccctctttaacagccttgcagtat

SEQ ID NO: 164 - DNA, 25 bp, Homo sapiens
  misc_feature (1)..(25): amplification oligonucleotide PG1Ae1b7
ggccctctttaacaaatttctctgc

SEQ ID NO: 165 - DNA, 28 bp, Homo sapiens
  misc_feature (1)..(28): amplification oligonucleotide PG1Ae1b8
gaaggccctctttaacagatgcttatag

SEQ ID NO: 166 - DNA, 26 bp, Homo sapiens
  misc_feature (1)..(26): amplification oligonucleotide PG1Ae3b4
atgctggattatagcatggaggaatc

SEQ ID NO: 167 - DNA, 31 bp, Homo sapiens
  misc_feature (1)..(31): amplification oligonucleotide PG1Ae3b5
caaaatgctggattatagatgtatcttgtga

SEQ ID NO: 168 - DNA, 23 bp, Homo sapiens
  misc_feature (1)..(23): amplification oligonucleotide PG1Ae3b6
tgctggattataggccttgcagt

SEQ ID NO: 169 - DNA, 28 bp, Homo sapiens
  misc_feature (1)..(28): amplification oligonucleotide PG1Ae3b7
tgctggattatagaatttctctgcaaag

SEQ ID NO: 170 - DNA, 30 bp, Homo sapiens
  misc_feature (1)..(30): amplification oligonucleotide PG1Ae3b8
ccaaaatgctggattataggatgcttatag

SEQ ID NO: 171 - DNA, 21 bp, Homo sapiens
  misc_feature (1)..(21): amplification oligonucleotide PG1Ae5b6
tatctttgcatggcagccttg

SEQ ID NO: 172 - DNA, 23 bp, Homo sapiens
  misc_feature (1)..(23): amplification oligonucleotide PG1Ae5b7
ctttgcatggcaaatttctctgc

SEQ ID NO: 173 - DNA, 27 bp, Homo sapiens
  misc_feature (1)..(27): amplification oligonucleotide PG1Ae5b8
ttatctttgcatggcagatgcttatag

SEQ ID NO: 174 - DNA, 20 bp, Homo sapiens
  misc_feature (1)..(20): amplification oligonucleotide PG1Ae56b
ctgcccaacgtgggaaagac

SEQ ID NO: 175 - DNA, 21 bp, Homo sapiens
  misc_feature (1)..(21): amplification oligonucleotide PG1Ae46b
gcaggaactccaggaaagacg

SEQ ID NO: 176 - DNA, 25 bp, Homo sapiens
  misc_feature (1)..(25): amplification oligonucleotide PG1Ae36b
tgttactttgctcagggaaagacga

SEQ ID NO: 177 - DNA, 22 bp, Homo sapiens
  misc_feature (1)..(22): amplification oligonucleotide PG1Ae26b
atcaaagcacagggaaagacga

SEQ ID NO: 178 - DNA, 19 bp, Homo sapiens
  misc_feature (1)..(19): amplification oligonucleotide PG1Ae16b
ccggggtccagggaaagac

SEQ ID NO: 179 - DNA, 56520 bp, Homo sapiens
  misc_feature (2001)..(2216): exon 1
  misc_feature (18196)..(18265): exon 2
  misc_feature (23716)..(23831): exon 3
  misc_feature (25570)..(25659): exon 4
  misc_feature (34668)..(34758): exon 5
  misc_feature (40685)..(40843): exon 6
  misc_feature (48067)..(48190): exon 7
  misc_feature (50179)..(54519): exon 8
  polyA_signal (54493)..(54498): AATAAA
  primer_bind (1991)..(2008): upstream amplification primer 5-63
  primer_bind (2505)..(2525): downstream amplification primer 5-63, complement
  primer_bind (4091)..(4111): downstream amplification primer 99-622
  primer_bind (4528)..(4546): upstream amplification primer 99-622, complement
  primer_bind (5475)..(5495): downstream amplification primer 99-621
  primer_bind (5927)..(5947): upstream amplification primer 99-621, complement
  primer_bind (8127)..(8144): downstream amplification primer 99-619
  primer_bind (8560)..(8578): upstream amplification primer 99-619, complement
  primer_bind (11622)..(11639): upstream amplification primer 4-76
  primer_bind (12018)..(12037): downstream amplification primer 4-76, complement
  primer_bind (11930)..(11947): upstream amplification primer 4-77
  primer_bind (12339)..(12358): downstream amplification primer 4-77, complement
  primer_bind (12915)..(12932): upstream amplification primer 4-71
  primer_bind (13317)..(13334): downstream amplification primer 4-71, complement
  primer_bind (13216)..(13233): upstream amplification primer 4-72
  primer_bind (13617)..(13636): downstream amplification primer 4-72, complement
  primer_bind (13547)..(13564): upstream amplification primer 4-73
  primer_bind (13962)..(13981): downstream amplification primer 4-73, complement
  primer_bind (15994)..(16011): downstream amplification primer 99-610
  primer_bind (16463)..(16480): upstream amplification primer 99-610, complement
  primer_bind (17304)..(17324): downstream amplification primer 99-609
  primer_bind (17814)..(17832): upstream amplification primer 99-609, complement
  primer_bind (18008)..(18027): upstream amplification primer 4-90
  primer_bind (18423)..(18442): downstream amplification primer 4-90, complement
  primer_bind (18699)..(18716): downstream amplification primer 99-607
  primer_bind (19164)..(19182): upstream amplification primer 99-607, complement
  primer_bind (22589)..(22609): downstream amplification primer 99-602
  primer_bind (23111)..(23129): upstream amplification primer 99-602, complement
  primer_bind (25098)..(25118): downstream amplification primer 99-600
  primer_bind (25657)..(25674): upstream amplification primer 99-600, complement
  primer_bind (26537)..(26557): downstream amplification primer 99-598
  primer_bind (27022)..(27040): upstream amplification primer 99-598, complement
  primer_bind (32262)..(32281): downstream amplification primer 99-592
  primer_bind (32823)..(32841): upstream amplification primer 99-592, complement
  primer_bind (34215)..(34233): upstream amplification primer 99-217
  primer_bind (34624)..(34644): downstream amplification primer 99-217, complement
  primer_bind (34473)..(34491): upstream amplification primer 5-47
  primer_bind (34916)..(34936): downstream amplification primer 5-47, complement
  primer_bind (34702)..(34722): downstream amplification primer 99-589
  primer_bind (35182)..(35200): upstream amplification primer 99-589, complement
  primer_bind (39591)..(39611): upstream amplification primer 99-12899
  primer_bind (39971)..(39991): downstream amplification primer 99-12899, complement
  primer_bind (40531)..(40549): upstream amplification primer 4-12
  primer_bind (40932)..(40950): downstream amplification primer 4-12, complement
  primer_bind (40629)..(40649): downstream amplification primer 99-582
  primer_bind (41058)..(41078): upstream amplification primer 99-582, complement
  primer_bind (45729)..(45746): downstream amplification primer 99-576
  primer_bind (46186)..(46203): upstream amplification primer 99-576, complement
  primer_bind (47879)..(47896): upstream amplification primer 4-13
  primer_bind (48217)..(48236): downstream amplification primer 4-13, complement
  primer_bind (48902)..(48922): upstream amplification primer 99-12903
  primer_bind (49331)..(49351): downstream amplification primer 99-12903, complement
  primer_bind (49830)..(49848): upstream amplification primer 5-56
  primer_bind (50271)..(50290): downstream amplification primer 5-56, complement
  primer_bind (50172)..(50189): upstream amplification primer 4-61
  primer_bind (50573)..(50591): downstream amplification primer 4-61, complement
  primer_bind (50541)..(50560): upstream amplification primer 4-62
  primer_bind (50940)..(50959): downstream amplification primer 4-62, complement
  primer_bind (50555)..(50572): upstream amplification primer 4-63
  primer_bind (50964)..(50983): downstream amplification primer 4-63, complement
  primer_bind (50774)..(50792): upstream amplification primer 4-64
  primer_bind (51183)..(51202): downstream amplification primer 4-64, complement
  primer_bind (51146)..(51165): upstream amplification primer 4-65
  primer_bind (51479)..(51496): downstream amplification primer 4-65, complement
  primer_bind (51593)..(51610): upstream amplification primer 4-67
  primer_bind (29734)..(29744): upstream amplification primer 4-67, complement
  primer_bind (51167)..(51185): upstream amplification primer 5-50
  primer_bind (51667)..(51687): downstream amplification primer 5-50, complement
  primer_bind (51387)..(51403): upstream amplification primer 5-71
  primer_bind (51826)..(51843): downstream amplification primer 5-71, complement
  primer_bind (51772)..(51789): upstream amplification primer 5-30
  primer_bind (52199)..(52217): downstream amplification primer 5-30, complement
  primer_bind (51850)..(51867): upstream amplification primer 5-58
  primer_bind (52382)..(52400): downstream amplification primer 5-58, complement
  primer_bind (52507)..(52527): upstream amplification primer 5-53
  primer_bind (52997)..(53017): downstream amplification primer 5-53, complement
  primer_bind (52703)..(52721): upstream amplification primer 5-60
  primer_bind (53142)..(53162): downstream amplification primer 5-60, complement
  primer_bind (53001)..(53018): upstream amplification primer 5-68
  primer_bind (53521)..(53538): downstream amplification primer 5-68, complement
  primer_bind (53459)..(53476): upstream amplification primer 5-66
  primer_bind (53920)..(53940): downstream amplification primer 5-66, complement
  primer_bind (54202)..(54220): upstream amplification primer 5-62
  primer_bind (54681)..(54701): downstream amplification primer 5-62, complement
gtggatctgtgactgttcgcaggaagagaggagcgggagcaggacagacaataactgatagtcaggagctgggtttggagataaagagggaacaagagaaagttaagttctgtgttttcatggcaaacattgcacaaaagtttacaacttcgtgactaacagtaatctggggtgattcacaacaaatttacacataaacacatatttactgactttatacacagcaatcctaacgtgaacacagaacctgctttatcttttcgcacactgttctagtgtagagatgtctggtctcagttaaagaaagcataaggagcattagttgtgcacactgtccacacccgtgacttttttccaccagtactaaacctagtgcttcttacagtacagggcaatgacagccacagaaagagagaagctccttttactgtgtaatgcttcctgctggccttcaaatacttgttacttgagagatctccattcacctggctttgtccccaaaggtcatcatctaccaatgatgttgttatttgatgttaatcatgtataaagaaagtagctaccatcctggccctgattagaacttcccactgaaataccgtcctgcctaaaggtagcacaggtttccattatggtggtggtggggagggggcgggaatatatatatatatatatatatatatatatatggtaaagcattcggcattcttttaaagtacaactatccttgaaaagggttacatattaaaccatttttaccacagccaaaggggaggagaaagatccaaaagtcctgtggatctgctttaacatcaataaaacagttatccacccttcgtagcttttagtgaaggctacaaaagtatgctttttatggattacacatgtgcacgcaactactttaattactacagaaaaaaacgaggctccttattaaaaaaaaatcagaaacaagtccaacagactctgaggaaatgaagcaagagtgaattctgaaaaggtctaataaacagtatggaaatatccttgtgggattgttcttcagctatgcataaacatgtaattatcatcattactgtgatggggaaaaacacggaccctaattctgaaacaccctggtagcgagagacgggcaggaggggctgctgcgcactcagagcggaggctgaggaggcggcgtccccttgcaaaggactggcagtgagcagatggggacactcgagctgccccgcgacctgggccgagctgcctacaacctgggcccaggtgcctgcaagaattagacctccgataacgttaacacccactttctcactgctctaattgtgtgcatcccggcgcccaggggcttgtgagcagcaggtgcgcgttccaggcagctccagcgacccttaaacctgaccgcgcgcacgtccggcccgagggagcagaacaagaggcacccggaccctcctccggccagcacccaccttcacccagttccgtcagtcgccaccacctcccttcccgcgtccgcagccggcccagctggggagcatgcgcagtggccggagccgggttgcccgcgccacagcaggtagctgtactgcaactgtcggcccaaaccaaccaatcaagagacgtgttattgccgccgaggtggaactatggcaacgggcgaccaatcagaaggcgcgttgttgccgcggagccccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatgctgctgtccctggtgctccacacgtactccatgcgctacctgctgcccagcgtcgtgctcctgggcacggcgcccacctacgtgttggcctggggggtctggcggctgctctccgccttcctgcccgcccgcttctaccaagcgctggacgaccggctgtactgcgtctaccagagcatggtgctcttcttcttcgagaattacaccggggtccaggtgagccgcctcccgctcccgggtctcggcgtccacccgagctcccgggggcgcggacctctccgctcccccacagctggcgagggtcacccggccggcccggcggacccagcacggagagcacgtgccgcctccccgccttcctctccgcatgcttcctgccgttctgccgagatcgctctctaggaagctgtggctgcgtcgtcctgaggctacgagtgggacccgccgcccctttccccgcccctcgcctgggtctgatgctgcttagcaaagtgggtgcagatgcacgttttaaataatagggcacgcgtttagcagtttctggcctttggtccaaagaggtggtcatgttggaacagatcggagacgtctacactccgaagtgcgcttttacagtgacctcttgaaacagaagtacaattcggtcttgtgttctttcccctggacaagtgaaagctgggcgaagaaatgaatacatttgttaaccgtagaagcctaactagatacaattcttgccaactttaactgggcttgaatgtgtgggtgatctgttgtctgattactttctttctgttactgtttctctgtagagattggattcgtagattaaacttgagaaacaaaccataaaagtggaaggccctctttaacagtaggtatttgaagtgttataaaaaaaaaaaaggtgaatttttcttttatttctcagtttgaaagaacagctttattcttggttattcctaatgtccacctagtcctcttttacttttcttggtagggttagggtggcatggggaaatgggacggtatcattttgtctttttaactttttttttttccacctacagcagctgtttttaccctgtggtcagtcaggtactatatttagtttgcagttgcactgctgatcgacccttgatggccccagttggaagttgtttggggggaaggaactaggagaggccagggcctccatttaaaccagtgtctgtaagtgtctccttggaaggaaaaaaagatactgttccaggtcatggtttcctggtagttgacgtttaaaatgggcctcatttaaaaatttcaataattcaggctaattttttccctttatatggtaactccaccaagtttgtctaaatgtatgatttttatcatgattaagtttttacttccacatcatgtgacaactggcctgggatgggatataagctcagaacacaaagtcattcacctgttaaaaaaataattctatctgtggcgggttatgttatttttgttcaaagaggacacaatatgatgcagaatacaccattgaaggattttttggtttggcaagttcttatttttttaaatggctgtaaaacctagcagtgtttctgaaattgcataccttacctgatgttcagagatccgatttacttcttgatttcccagcaagtgattttgaaaacatttaatctaatcattccccccaccgtctgttcaaatcaaaggaagtggcatccagcactaattttcatgcatttatgaaaggatgcctgaggacccttaagtataattcaaaattttgtttaatgtgtgttccttgatgaagttctttaggagtcgtagaacgaactgattgcccactgatcatcaaatgcaagttatgaacatttaataaaaatttaaaaccaagagtttcttgttcctgcatttttatttttattgtatggaggggacaaataattattttctgtttagtaacagagcagggtattttgaatttattagggtctttttctgcagtctgggtttcctgtgtacacaaagctacctttcaatattttttattgtttctgttaagattaaatcaatagaggaataaatagctatcttcaaacataagacccaaaggaaaaagatttatagtgatgttctgtcaccttattttttacctgtgactttgtaccattaactttgtcactgagatgttttgattaaaatttttagcttgcttttcttgttttgttaggacactctttttttcttgaattgtttttatcagctttcgtttgcaaggctagtgatgattctcttgttctgtataaagtattgttgactcatttctgaagggagttttagtaatttaagaggttataagtttttaaataaaaggtttattaatttatatatattaaagaggcattttaaaataaaattttttttaaatgacatttttacacctttcaactctaggtttaaaaaataagtggttcacagtagttcttgcagaagaatattttcttttacatagaatttttaagctgaagagaagtagtagtaggtccatgagatttatgatctgtgcttggcaggtaaacctgcttccaacaaatttagttggatttttcttggattctgggtaaatacctttttcttccccagtttcactactttattttcatatgtatctctgagatagagaaatatttcagtcagtgctgctaaaattgttccttataactcgtttatccttttaggtccttccagaatctctcattggtactgaaactcaaatgggtactttcttcaccatttatttctttagaataagtaataagaattttataagcttttttatatttcacgtaatttgagactattgaaaatccagttaagtctctctactgtgttgagaggcattgattcaagtacctgtgttactttcctgtgctgccaaaacagatcacctcaaactaagcggcttaaaataatagaacttaagttctcgtgattctggaggccagcactttgaaatcaaggtgtaggctcaattttactccctctggaggccctagggggaatctgttcttgtgggtttcaacttctggtgactggtggcattccttggcttggggccccatcacttcaacctctgccttacagtccttgctgccacctcttctgtctcacatctcactctccctttctcttagaaggatgcttgtcattgggtttagagcccacctggatattccgggatgatctcttcatctcaagatccttaattataactgcaaagagcctttttccaaataagaaaacattcacaggttccagggcttaggatgtggacacattttttgaggggctgcccttcattcccccacaacaatgaactccatagttctgcctattcagtattttgtagttatttcgtagtttaacttgccttatttctttaggtatttacgtattaaagcattttggtctctgctttctttaacagagaacctggttttctgtaataagtttacttactttcccataatcttttagtttcttatttacagatttaccttcacatatcccttaagtagaacatttgattaactgttttattttcggaacaaatctgcattctgtataataaccaacttattcatatttcggtattcttttaattcttatctgattctgaaattaccatcttgtgattatatatatatatatatggaaataactgaaatcttgataaattaaaggtgatataacttctaagacaattaattatgtatgatgtggtgaatatactggtgtttggtttgtttgccacttaaaagccctatctataggataggaagtaacttgaatgtggaatgcttagagactcagagtaagaggccgtatatatatccttgagctggagtttaaggaaaacttatgggaaattaaaaggaaagttggagtactgacagaggattgcgtaggactcatgaaaaaggaatgaagttaccttaaattctatcatcgtgagttaacgtgaaactagatttatgttagtttatagcctagaattctatcctaggaatctagatatatcctaaatgttgagatagctgcataaacaataactgtaatcgttatgataaataatgacaaatctttttagcatgttttgtgaagctgataaatgttaataggatgtcttcaaatgtcagaattcttttttctttgcttcttttttaaaaaatttcttttcccccattcctatgcaatacactgaaaactgatcattgaaatttgtaggccaaaaaattaatcaacacgtaatagattggggtttgggtttttttgagtcagggtcttcttctgtcacccaggctctggtgcggtggcaccatcatggctcattgcagccttgaatgcctgggttcaagtgatcctccggagtagctgccgtgccattatttctagctaatttttaaaagtttttgtagaaatggggtctttctgtgttgcccaggctggtcttgaattcctggcctcaggtgatccttctgccttggcctcccaaagtgctgggattacaggtgtgagccaccatgcctagcccctaataaatattctaattaccgatttatcttgcttaaatcagttggtaacacttggaatttacttcagaatatattttacattagtggctctgactgctaattcccccttctccaaatgctaatgtaatataacaataaaatgcacagttcttaagtttatataaaataaacaggttttcagttgacctgctttaagtgtaaaatagtgtgaaaaacacaagaaagaagataaagaatttaagattttgacatttctctaatatgcccttaacttctccaaggattcatacttttttttgtaagacagaatctcacactgttgcccaaaccagaggtgcagtggtgcagtctccactcactgcaacctctgcccccgggctcaagcggtcctcccacctcagcctcctgagtagctgggactacaggtacacagcaccatgcccagctaatttttttttttggtattttttagtgggggtagagacgagattttgccatattgcccagtctggttttgagctcctgggctcaagtgatccgtccttgatccaccatgcttagctgattcatactcttaactgaaacattgttccaagtttctcagaaacagtcaaggctttttatctagagaacatttataactggatctttctttgtgtagcactgattcatcaaactaatcctaaactcctaatgagttaaatttatattctgaatcttgctgtaaaagcagccattcattagaatgaaacatgtttacttagaattggagaagggagcttataagtcatctagtctactcccttttatgacacttctacattctttctgcacttctgccaaaatgttgcccagcgtcgtctctgatacctatagtcctaacaagaatatgaatcataccttgtatccttaattttactcttctctgcttatttgccattcatgtgaagaccttaaatagatcttaaattgcttccttcactttagctgagagtgacaggactgtgtaggtgtgggtgtgtttctgcatttgcttatttaagcaggataataaaaacttttactataggaaattaaacatttcccaatcaaatacaattccagtctaacacaattaaattctggttagggaactgcttaacttactagacttataggaaaatactaaaaaaatgtaactagaactctatttttacactttataaatataaacctctgtgaacaaaccagttatttcaggttgcatttgtgtatagttttttaatgcctgatttttctattttaaaatcacagatgcaattatacattcaaacactgccacaatactttgagaaagttaaagtttcccctactcctacactgcgtacacctttcctaggtacatcccagtttggtgtgtaactttagatttcttccaagagcttttgagtaagtgtttgaattgtgggaaggttctttagttaaatgaacttcttacagatcagttttttagtacagtagcacgaaatatacctgcatacctatggggatacctctgtgccattacgatggaaggcacgggaaaacagcactccgtatatacctagtttactttccctcttttgtatatttgtctgattttgtggagctgatgcttctcaagtggaatcagaagttaacttttcctttactattttctcattttattatggtttcttaactagaggttgatgttagtggttggaccattcaatagtaagtaatgacttttcagtaagggatctctagaacccagatcccttaattcctgcaatattcccgtgtgtacattgttccaggtgctgtcctgggtaccaagggatacaatgtttgatagacaatgtacctgccattatggaggtcacattctagtgtgggaagacaaacaataacaagaaaatgaaaatttactgtgccatgccaggttgtttagcctggtgggtgagaggtaggggtttggaaaatcttactgagcaagtgacatttgtgtggagctctgtaaaagggccagcttggaaggtaatgtagtcatccaggtgagaaatgatggttaggggagtggaaagagtggatgttaagattgaaaagaattccaaatctattttagtggtagctgatagggctttgtgattgaatgtggaggaaaaagaagagggtgggttagtaacacactcagtcgcagttagtgagtgctgctgtgtgcaagtattgttctattatgtaaataattccatctttacaaagtaggcaccattcttcctcttttacagacaaggaaaagggaacacccatggttcacatctgtagtagcctagccaggagtttcaggcacttattttctgaagatgctctgcctggcaatgtggttatattggttgaaatgagaccccctactttcaaggtattcatctaggaaagacatgaactgccaattacaatataggataacactgaaattagagacgtgtttattaactttgccatacagaggtaaagtaactctttaaagtaactctttgcttgggttagtggagaaggctataaaaattacttggagtttttactttgaacatgcgtaattaacatggaatgtttagggaaaagaggttttcaattgataacataataaacatgaggagtttgaagcatggcattcaaggttttctaaattctgccccggttaacttttccattcgttggtttcattctagtctagcttttccttctgggccgcccctccccacattagaccgctcctctctggaattccaactcaagcccttgcttttctccatctgtcatgatgttaccccatctcattgtcagggtaacttttatgtaatattaacatatataatactgatataacattagcatattttaatgtatggatcatctcctctgcaacattgtaacctcttggagatggcaataatgggaagaatgacttgattttactttttcttttaacaaaaatggtggagtagtctgggcacggtgtggctcatgcctgtaatcccagcattttgggaggccaaggagggtggatcacttgaggtcaggcattcgagaccagtctggccaacattgtgaaaccccatctctaccaaaaaaatacaaacacttactgggcatggtggtgtgtgcctgtagtcctagctactcaggaggctgaggtgggagaatcacttgaacatgggaggtagaggctccagcttgggcgacagagtgagaccctgtctcaaaagaaaaaaaaggtaaaagggccaggtgcggaggctcacgctggtaatccaagcactttgggaggctgaggcaatggatcacctgaggtcgggagttcgagatcagcctgaccaacatggagaaaccccttctctactaaaaatacaaaattagccgggcgtggtggtgcctgcctgtaatctaagctacatgggaggctgaggcaggagaatcacttgaacccaggagacagaggttgtggtgagccaagatggcaccattgcactcccgactgggcaacaagagcgaaattccgtctcaaaacaaacaaacaaacaaaacaaaacagagagaaaaggcagagtactctagggaattctagtctgtgtttctgtggaaatgtatatgaatctcacttttaagggatggagatttttgaatggcataactagttgataagttttgctctaacagggtacccaagtctagtgagtccgattcattctttccttaaatagatgaaggaggaagaaacatgactccaccctcaagagtaaggcagaatgagcaaagtcagagaagttaaaaaagaattctcacgcagccagcagtgcagagaaaccttggtttagttgtgaatcaaaaccagtactttttgtaatttttgagcctatgcaattctccaaggttttatgttgtttcttctgtttctctgtaggcaccagaaatcaaaaccccaaataagaaagtgttacttgaagattttagagtacttatttgtgtataagtgtaagtgatatttggaagacgactttactgcgctcctccagcttggcatgagaattccaggggcggaaagaaaggagggtgatggtacctggaaaggagagtcatgttaagtcccagccacatattaagtgctaaccacctactgttaaaaggtgtaatgttctagactgacaaaatacatagtctctaccgtaaagtaacacataatttagcagtgcagaaagatgtcacttaaaagaaaacttgaatatatgctgagatagttcacaaattaaagaaatgaacaaagaactgaggaaataaaggaggaatacaactgtgtccaaatgaatacttaactgggtgggagctgttgcatatgtaagcaggtggttcacctaaaagttggatgtaacgtagttaacgccagctcttggtgcacttacatattgcattgcttccgggcttaatttgtgttcatataggaataaattttttgttggtttttaattttactccttgtaattccgtggttgatattcaaagtgaaaaaaattacataagcttctaatatatgagaagtcttctcacttgacattttttatttggaatttttgcagagagtagttttgtcacagtcaaaagattttgggatcttgcagtgagaaacctaggtgtaattcctatttctctgccattccgtatgtcatctggattaagtgtcaacttctcagtctcaagattctcgtccttaaatggaatactttttgtcatgctattttgaagacaaaatgagataatacgtgaaactgcctagctcagtgaatggtacatcatagatactcagaaaaaacacaccctctaaaataagaacagtaccaaaagacaggatgtaaaataagggcagtaccaaaagacacatgcatgctgagtgtatgagaaagaactttgtggccttcttgggtggcacaggccatggcagttccacagcatgacgtggttgctgtgggtggtagagcagacatgccgctccccgtcactgcctggctttgatgcttgctttcttcagctgagaggacgcagctgtgatatgaaggtcttgtgtgtacagtcgtgacctcacatttccaatttcctgctggcagaacccacagtctacaacgtacgagcaccagagttgacgtgagacagacagcatacagaggcttgtaacatccttctggaaaacactgtgtaagctttcagtgcgaataaacatgatcagtggcaagttctgttagatgtagtctgcaagcatcctgattttactgggcaagactatgttgatttacaggcggctgatgattccatggatagcccactactagtattttcacaaatttcacaagacattcttactggaagattgccctgttcttatgatactgctgcccttttagcttcatttgctgttcagactaaacttggagactacagtcagtcagagaacttgctaggccacctctcaggttattctttcattcctgatcatcctcaaaattttgaaaaagaaattgtaaaaattacatcagcaacatataggcttatgtccttgagaagcagcagttaattacctaaacacagcaagtaccttagaactctgtggagttgaattgcactatgcaagggatcaagtaacaataaaattatgattggaatgatgtcaagaggaattctgatttataacaggctatgaatgagtacctttccatggtcgaagattgtaaaaatttgttttaagtgcaaacagttttttattcagctttgaaaatgacttgcataaatctggagaaagattatcaggatttaatatggtgaattatatggcatgtaaacatttgtggaaagcaagtttagaacatcacatattcttctgtttggacagaccacttccaactagaaagaatttttttgcacattattttacattaggttcaaaattcctaatgcatggtgggagaactgaagttcagttagttcagtatggcaaagaaaaggcaaataaagacagactacttgcaggatcctcaagtaagccattgacgtggaaattaatagtttgggaagtagtaggcaggaattcaatatctgatgaaaagattagaaacataaagccttccatcacaattcccacccggaacaggaattcctactcatcaaaattctgcattcatacaagagggaacctgattatgaccatcttctgttggtcatttggtagattatgtggttcacacttcttccaaatatttgcaaatcagacatcaccattatcagcacaagctaatagcatcattctggaatcatcactattacaggacacccctggagatgggtagcctccagctttaccacccaaacaagctaagaaaaactgttggaaccaaattcattatttacattttcaacaagatctggaagatcatattaatgaaacgttgatgttctatcttctcttaaaaaatctgctcctaatggtggtattctacatgataatcgtgttctaatccgagtgaacctgacgaaaatggaaggtttggagtcaatgcaaagggggatatgatcagaagatgtctgtgatcgtgtcctgagaagcaccaggaacacctttgacctcagtgactctcgattgaagagaagaccaagttgtattgatcagtggttgggactttacagaacacacccatgattgggttgtcctgctttttaaagccaactgtgagagacattctggggaactcatgcttctagttctacctatgctgcatatgatgtagtggaagaagtgctagaaaatgagacagacttccagtacattctggagaaagccccactagatagtgtccaccaggatgaccatgtgctgtgggagtcagtgatccagctaaccgagggcttatcgctggaacattctggacacaatttgatcaacttatcaaaaaaaaacttggaatgacaatttctggtgccagattaccttagaacctttgcaaaaatagatagagatagttttccttatgatgttacatggcttatttttaaaggtaatgaaaactacatcagtgtaattccagcatcataagtcagaacagtgcttgtcaaggggcgttaccacacacttgaacagatttttggcagatgacttgggaacaaggctcctccatgtttgtaatgttgaccacacaagttgaatgtggcagagttaaatgaccccaatattggccagaacccacaggaagttcatcctatggatgctaccaagccttctgccactgagaagaaggaagcactgtctttatcttcaggaagatcacactgctgtttaaccaagagaaaaattagagagtcatcaatcacgcagatccagtacagagggtggcctgaccatggagaccctgatgattcagtgactttctggattttgtttttcatatgcaaaataagagggctagcaaggaaaaaccccttgttgtttcttgcagtgctggagttggaagaaccagcgttcttaatactatggaaacagccatgtgtctcattgatctcattgaatgcagtcagccagtttattcactagacatggtaagaacaatgagagagcagtgagccgtgatggtccaaacacctagtcattacagttttgcgtgtgaagtactattttgaaagcttatgaagaaggctttgctgaagaaagcaaaaggaaaaaaagaactttgtcatctgttaggttccatttattgcatgataattgtgtttgtattgattattgggcaagtagctgtttgctattttgatcttatttcagaagggcataataattttactattcaatgaaacgttttaaacggggtagaaaaagactagtttttgtatgctttacagcagaaatcttataatgattaactggtaatatatttcgttggcataaaaatacatttaaaagttcaagtaattataaacattgtaaattgtatatgtaatcatattgaaattgaaattctttatagctgtacttctgtgtaatcaaagactggggagagatagactagctagctctttctcttatccattaatcacttaacagagttttgaataaaaagttccatttcatgggataagaataatgacaggttaacctattttagttggttactatgttctaggtgttgtatgaagtagtttacatagtttcactgatttcactacaatcccaggaggagtagttactattattacactcattttacaggcaaagaaataggtttggaggggttgggtgttttgcccaagttctcatcgtaaaatgacagatgaggattcaaattcaagtcttaattgaagtccattactttagaacctacctcttagtggctcttatgttacagtataagggagagcagactgttcctttacccttgtagggtagctagggcttgtgaattaagagactgattaacaggagaagaggcatacacattttattgacgttagtatttttacatgcacagggaaggagggttttatttttatttttatttttatctttattttaaagagacaggggtcttgctgtgttgccagggctggactcaaactcctgaagccaagcgattcttctgcttgagattcctgagtagcagggactataggtgtgctcctctgtgcttggctaaagaaggggtttgtatgtgatttttaacaaaggctgataaattgtgaagaagtgactagtcaaaggagaagaggatttcagctcccaggggtggtaaattgtgggaagatgactaggaaatgtatagtaataaggtttgctatgcaggtttattttgccagtttctggtctcctaataagggacagggaaacacctttacagatggaaattcatatcacctttccacagggaaatttatgtcctgccttaggcagttaggggaagggcagagaattcttcctgtatctgctgtgtctcaggtgccttcagctcaaaataatccttatgccaaagtagcatatttgggtgtggcatattctctgatctctttcaacagcatcatctatacttaacaacagcaaaagttttttttaaaaaatcatgtttcaagatttgcatgtggaagacaaatggacatgattgagataaatgaagaatatatattttttaacaaagaatgctgtatatttatgtctctgtgacattgtgttatggaggctaaggtgttaagcatgtgattactttagatgccgtatgactacctgtttttaagattaaaaaagaatcaataggcagtttatatgcatgggagcaagttaaaaacaacacagatgtgatgaaggcgaggtgaaactggtccgcatctaattcaggccttctcctgaaagccagtgtgtgcaagataaataagtttgtttgacgaaagcagaataactagtttgtcctttgtgatgaagatagttattcagaaatcatttttattggctacctctgaattaataaatgaaaagagaaatttttttttctgtaggggatgtctgatgagttcttaaaaagtggatgaacctgaaattatcatgaacaagcaattataatgaacttaaaattacttaaagagttatgaaaaacaaaaagaaaagccgtatgttttcttgtgccttattttgaagtgacaaattatttgcagggtacatttgtagacggaactaatgtgatttaaaaaatgagtactagatttacagaatgatgcctttaaaaagtcactggtgcactttaattattttatttatgtttattctgaaactacctttattttgaaaatgaggtatagctttgcctactggtgacaaaagtgtaaataattcagtaaacatctgttaaaaaccagcttggtgctaggctcttggggtagaaaactgatcaggccattgaggagctcatagtccctaaggggctggggacttgtcattaggtgtgcagtgtgttctggatgctcctgaaggagtgtgggcaggtgcgcaccaccatgcctggctaatctttttataattatgtagagacagggtctggctgtgctgcccatgctgggtttgaacttctgggcttaagagatcttccctccctgcccctaccgaccccgcccgcccactccacctcagcctccccaaagcactgggattgcaggcatgggccactatgcctgggctgtgcaaaacttttaaatcagtgcatactcaatggtcttgatgcaattctggcttgttggtaagagaatggggatttactcacaagccacgatgtcacttttaactctgaacagatcaagctattggtattactcatttatgtcatcgataaactttatgaataaaaactcattgtgcaaatatttaaacatactacatacatagcactgtgcagtttctaaggaaagtaatggaaacctttgtcacatccctggcttccagaactttatgttatctaagtgcatttgtctgcaaagttgttgggttaattgcccctttctttcttctctttttaagatattaataaatagtgtcatgaccaaaagataatccttatggacaagatagatctaaaaagccttagctaatttataatcttgcataatccatgatgacaagatgcagaaacaaaaatgcccagaataaaaacttagcaccattagcagccatttccttttaagtctttacaagtatactcccagtttcttgaaaaatttattctaaaatatgtaagacacacaaaacagcagaaggactaatacaggtacatcgaacacctgtgtgcctaccgcccagtttaaaaataaactggaatgatgtttctctcatacttacagaataaagttttaatctttagcatggaattcaaaagacttctgccattccagttcagagccacccttctggtctccttgctcctcagccgcgacactgcccatgtacccaacaggcctccagggttactgcttccattcgttcttattctcatgaacattttccttcatctcatctgccagaatcctacctaataatactcctgctctgcagtttacagttctttaaaattaaaaaaggttgtgtaccctttagtgtcctgaaaaaagaaaaaacaaatttaaaaccttaaaaaggtaccatattttcatagtatttgcgttatgtctcattacagttcctgtggacatgtctgtctcttttactagattgattgtgggctctttgaaggaagatatatcttatgaacagtgttttatatattgttagcaatcaatgaatgcttgctatatttttctcatgaggatattgattattctattttaatttattaccgttaacctgtactatacataactgctttctgtacctgagctatttatgatctctgaggctcctgtgagaaatctaatttttgttaatcatggatggaaatattcacaacatcattcgtcagtttcttcacattgtcttcctttgtatattacagatgttttaaaatatcaaagtaatgtttttttgttttatcttttagatattgctatatggagatttgccaaaaaataaagaaaatataatatatttagcaaatcatcaaagcacaggtttgtatttcatttgcatgaaacctaggtttttctacagatggcacatgggcattcaaaataccgttcttatatttaaatgaagtgggttttttaaaacagcaattttctgtgcagatattacacctgttcttgtatttttgtgattttactttttggaaagtcagaaacttgaaagctatgaattttcctaaacttaccttctccctctgttggatgtaagtaagctatcttcttacttgcttgctttgtttttcctttgtgtagctctttaaagagtgtattcattctttttgtaagtgatgtttctagaagtagcattggtgggtcgaagtgtgtatacattttacatttttgattgctaagctgcagaaaagctgtattggtatgtaagtactcgtttccttactatgctcgtcatttctagtgtctgctcttcctttccttcttcaaatgggtttggtttaattctagttgctactgttccatcagaggaattgcagagaactggtcttcaaaacagtgcagtatatactttaggtgaagatacttctaaaaacctttgtattttgaggtaattctagagtcccaagaatttgcaaaaagagtacattgtcagcaatatttttcccaatggtgacatcttaatataactgtagcacagtagcagaatcaggaaattgtcattgggtaaggtactttttaattctccaaataattcagccctccaaaaaaatcccacttcttatgttttcaaacctgtagctacttttgatgcgtacttcctaaattgcatttttattactttaaaaaatataatacctagaagctcaaagctggaaacagcctgatcaatatagtactcttaagctaaaaacaacctgatcaatatagtactcttagggaaatcacttatgcctgtggctttttttaaattttcttcctgtcagctgtctcttcatgattttgtggtttttattactgcttataccatagatgaggtatagaaagtaaaagaagttaaaatgcatttttctcaatttagtgaattaatgattacattcagatttataggacaagggttgaagctacaaggggttgataggaatcttgatgtatctgagtattttccccaactttattacatgactggttcagactattttatctaattacatttcactcttggcagaaatagcaaaacagtcaaccaatggtcaatgctgctgagaactctggcctgtgcagacatattggctgttttacttctaataccattctgcttttcctgtcctgctgctgatggatgtttcttccaggttttaaatatcaaacaaaagggatctgtgggcccagtacagggaatggctcttgatagatttgattttcctgcatttcctttattttgatccagtgttaatttcatgtagagttgtctgtttaacaggattctcttaaaattccttcttcagtttacctgccagcttttctttgtccaggtttcagtatgaactccactcgattaatagagctctctagtagtgacttgtggagtgggttctctgaacatttctggaagtgttgctgatagtgataatattgatcactagtactgttaatttgtgtgcttactacatgttggcttttatatgtattccttcagattaaggacttctagaaaacatccatgaaaaaacagattaaaaaaaacaattctgcatgtatttgggactagaaggtactatgggaaggataatcttcatactcagaccatactgacctgaatttcatttatcagtttagagaaccacttccccttcccttcaccctacctccgagtgcctgtgactttgtatcaccgctctggcaccacatcctcatcccagcaggatttgggaaggctgctttttgaaagccttttaaaattctgtaagttgagaaaatactaggggaatgattttaaatttctttagaattacaggctttagtcagtatatgacagagccttttcctagaaaaatgtgcatataaaaatttgcatgtagttttagggtttcagagacccctaaagcctatccatagacgtggttcattgtctgattgtgtttaggtacccttctaaaacccttttgagatgttaggaatcacaacagagtatctctgaaaatgtaattagcggaaagaacatttcaaagactgttgttctgcttagactttctagtttgtcttctgccaggcttgccggaataaatgagtttcctggcctgatactcaaaagaattgacatttaaattagtctctctcttcccttgttttcgcttgacacatccttgtctctacattctgtctctgtctctgttagcttatttctctctcgagtcagcaggatatagtggctgttatttcttccccttatccttcaacgatctacttttgacaacactttgcctttttttttttgagatggagtttcactcttgttgcccaggctgggtgtaatggtgcaatctcagctcactgcaacctttgcctcccgggttcaagccattttcctgcctcagcctcccgagtagctgggattacagacatgcaccaccacgcctggctaattttgtattttcagtagagatggggtttcaccatgttggtcaggctggtcttgaactcctgacctcaggtgatctgcctgcctcggcctcccaaagtgcagggattacaggcgtgagccactgtgccctgcctgctatttgcctttttaatctcatgaaatgttctcttttcttggctgaagtgtcacttttcttgttgaacagcatgcgtggtgagtagaatgttataaaaagggatggactttggagttagagagacccaggttcctgttcggcattgcagaaatgctgttctgcaataggctgtgtgtcagtgggcaaattacttatctctcagagccttattggtaaggtgtgagtgatagctcctttcaggcaccttacagaggctgtctcctaatcctggtagcgtacctggctcatagatggcatttaaaagtggttgtgatgacagtcatagctcaccattagcatagcgctggatccatggcagggaagcgctgcacatgcagtatctcttggactacacagggccctcatgaattaggaactgctgtttcatgaggatagggatgaggaaattagacttgctgcccctcactgccttccactcctctcctccaagttaatgggaactatgactctgctttggcttgattgccatggaagattctcacacagccaaatttattgctatcttagttaaattatgccagaacacaaaatatgaagttattgtcaaagtaatataatctcagctgtaactgagatagtcagaaactgtctgtaatctgatgtcctatctgaaaggtagctgagaataaacaagaaataaagagaattcagtagcaaatattggtgacacaaagcttttatattttgactagttaagctagttcttaaatgtttccactaaaatattcaagtttaagggcatagcccagggcagcttattatgaacatgatgtattttggaaatcttacactttctcttaaaagttcttgggaggggcatgtgaggccataatataaccataaaaccatttgttttaaaataaaacccatttttaaaattcttccaaataaaaaaattattgcaggaaaaaatgctaaacctggtttttaactttgtacgccaactatatttccaagatgtgctgtagcctggtaaccatacagaaccatacagaattagttctcagaatttattgtctgcttacttttgcatttggtacaggtataacagggtcgattatatggtttctaagacatgactagaaagaaatatgtttatcagttattatttcttccatctaaattagaaggggctagggagagggcttcaacaggaatttatatactttagagaaaagtgatcattgatagcccaatagtatagatatctcaacccaataacacaggttgtgtctgtctctgggatcatacactgtaggggagaatctttgcaagcaacattctacttatagggagccataacaaaagtttcatatgtataataattataagtcttaagtcatcaagaaaaagttaacttgtgaatgataatccctgattaaaaagagagatgtataataatggataagagatttttcttggttaatttttagtattaaaatggctaaatcttctttgggatattctgactagtatggtgcattgtctaatagatttcccatagctgagagctaatcatcttgtaatctgtggaaaactgtcctctttggctaaaactttattgtaattcctctaaatcctcagcttttattttctacagacttttttttttttttaacatttccttcctctgactcactccttttgttctcattttcatggcctgagaacatgggtgatgatagaattattcttttcacagattaacagttttcttttcgagtatcgttgagctcatgtgtgtattaactagagaagtctcccttacatttcatttttatgttttctttctcatcaggagatagtttgtagccatttactttcaaatccaagtttctgcggttcttaagacctgtatcatttgtctcctgaatttcacttcatttcctctttaaaccatgtcctctgtttcccatcttctgcacccactttgccacttcctgtttgtttaattggcaagggccactctctgtgttggaaattttttctttttgaaagctcaactaacaacttctaggaagttttttattgctactgttatcaattcataccatcttacccttgtttttgcaaccctttgttaataacatatttatttaactatagttattagcagtctgagatcattttacttggttacataaggagcacatatatctacccagcatcattgtaaggcatgtgagacctttgtttgattgctgtcctaacctagtaccgagtcctaaaaactcattagtagaagatgaagtgtccttgccttttgctgaacatatatatacacactgaatatttagtggcaattcatagttgcatttggccattttttgtttataatttcccctttctcattaaaaaaactttgttttctagactttaggatttagagaagctcattttgttccatacacatgctgctgttggattatttaggtattttgtgactgtattttatctttgaaataaaaagcctttcaagaaatgcaaaaaaaaaaagctcaaaaaacagaaaatgtatattttttaaatatctcagatagatttaaagaaattttaaacatcctaatcatagtacttttgaagcccattcatagtacaacctgtgaagagcctcatgtacgcgctaactgggtcctgtctctgcagttgactggattgttgctgacatcttggccatcaggcagaatgcgctaggacatgtgcgctacgtgctgaaagaagggttaaaatggctgccattgtatgggtgttactttgctcaggtaacttgtttccatgcttttctctctatatatgtagtttataaatttttttttttttttttggagacagtctcactttattgctcaggctgagtgcagtggtgtgaacacagctcactgcagccttgacctctggggctcaagtgaacctcctgcctctgcctcccaagtagttgggaccgtagtgcccaccatcatgcccggctaaattttctattttttgtagagatgggggtctcgctgtgttgcccaggctggtcttggactcaagcaatctgcctgtctcagcctaccaaaatgctggattataggtgtgaactgccatacccaaccctataaaaatgttatattttaaaatttaacaatatacttcatgtgaatgtatggtttttaaaatgggtttaatagtttattctcagttgaagtaattttgtttggcatttttagtggtgtgtatttatatacgtctgattatccatatgcggttttccttcagcatctgtggggattggttttagaaccaccacagataccaaaatctaaggtgttcaagaccctcatatagaatgggatagtatttgcatataacctgtgcactactttaaatcatctctagattacttataatatctaatacattataaatgccatgtaaatggttgttatactttattttttatttgtattattttaattgttatattatttttaatttttatttgttcacatatttttgatctgtgatttgttgaatctgcagatgtggaactcatggatgtgaagggccagctgcagtaaaatgaaagagcaaaaatgcaaatgtacaaagttcaaacaaataggaaatttaaaggcatagaatttgataggcaattacattaaactgttgataacagtaattagtgatctgtatgatattaaaaaaaaaaagcaaactgtatatataaaacttactttctccagttctggaggctagacatccaagatcaaggtgttgacagggttagtttctcccaaggcctctctcccaggcttgcagacagcatccttcttcctgtgtcctcaggtggtttttttccctgtgcccaagcacccctggcactgcttcctcttcttagaaggactagttacactggatgactaatccttctacagagactgctaaggtcccactctgaggcccttttttaaccttaattaccacctctaagtccctctctctgaatacagtcacagtgggaactattagggctttagtagactgatttgggggaacacacttctgtccgtaacagtgccacataaatatctttagcaggattgattttttaaaatccctaaagatcgtgagtattgacatgttaaggacgctttttagtgactctgtaataagtgggtggaagaattgggagttaaatccatctgatggatcaggttttttatttttaaaaatgtgtatttaagaaagaaagcattttcattttaactgccaacaaaactaaacttcatgtgttttccaatacagtgtcacatgcagtttttttgaattatgttgagacaaggcaattttcagctaaatgttctttagaagctaatgtttgaagatattaaatatagattaaattctgaaatgtagttttcattctgtactttttgcaagagaagttgcctttttgatgactctggccaattgttattttaaaagtaaatgctctttctcccgatttgattgtggcagcatggaggaatctatgtaaagcgcagtgccaaatttaacgagaaagagatgcgaaacaagttgcagagctacgtggacgcaggaactccagtaagagcctacccgtttttatttttcttaccagctctcagtttctaaatttaagaattaaattaaaatctaagaattgttttgacaatgtattttcccatgtgtaattactaattcagggttatgctgaggtaacagaaaccctctatgtacaggtaggcaggtttttcagccatcagaaagattgctgtaaacaactaggtcctttgctggtcagtggaccttaaagaggaataaaaagagcatttggtgtcgttcagagtctataaatagaactaactgcattttaacctgacatttaagctagtttacaagctcatcttacttcttgtcttctttagtatcagatttggttttagaagcagcaactgttttctgttagtgcaaattttgaatgtcttacatgtacagaaaaaccaaaaaaggatgaatctctacaaatgttaaatcattcagtgtaaataatattttataaaactttattccacaaaagtggggagagttcaatctgctttgtatagaatgctgattgctgccaaaggcttttcccctggttccctccggagacaaagcaccatgatcaccggggcgacttgggctttctctttcagtacatgacatgtgctcagaagcttagctcgtgtgcacaggctttccctttcctttctggctccctccctctgtcttccctcctctcctcttgccctcccctcaccaggggtcctgggcagcagctggagctcatggtgaaggaagaattcttcatggtcagctggcgaagtgcctggtgtgagcattgtttattcacatgcctcttctaggtgtttttacattagaacattgcatctgttttgggcatgtgttgggtgacagaagcagaatggaatgagatgaacagtgaccctttatcctgttatagctaacccttgagaaccaagcttggtgtcttcaaagggtctgtttagtctgaaacagtgtggtgaatttgggcagaattgtggtcattgcatgtaggtctccaaaagacagaataagttggtaatatggtttatcgactttttacaaaaaaaatttaaaaatcatgaatttataccttaaaatgtccatcccacttctctcccagctgtccagtcaccccagcaatggatgactgctgtggagttccttctgtgtcctgctgtgggcattgtatatatgaagcaaatgaagatagctgccttttgggtgatgttggcatcctatgcacagtggtcccttgcttttttgcccccatgaatatagctgccagtggcgctagggctgaaaaaatcagctctttacacttgtcatgtgtcttgtttatgtggctgccttcgtgagtttcttcttgtttttggtttgcagcagtttaagtatcatatatctgagtgtcatttaaaaatttttacctggattggtcctctgagcttggatctatgatttggtgtctgttattaattttggaaatttctttgctcttatttccttaaatattattcctaccccagtctttcttctccagttatgtttgtgttggttcatttctcgctgttctttagttcttagatgcattattcgttttttgttggtttttttttaaatttttttttttacgccccctcccttttttctttttgtgttacattttggataatttctgttgacccacctttgagttcatggattcttcctttggctgtgttgagtctactggtgagccagtttaaggcactcttcatctctgctactgcgtgtttcattcctcacatttccctttgaccctgtttcatagtttccatctctgtgctagtgtatctatctgatcataaagcttagtcacgttttccagttgaacctttatcattttattatacttgcagttctcttaaattccctgcttgataattccaacatctgggccatatctgagtctgcaaattttgattactttatctcttcagattgtgctttatcttgcctttgtcatacttcctaagattttgcctaacgctgggccttttttgtaagacaggagaaatggaggcaagttgtcttgatacctggaaatggatagacttgtctttctgcttggcttttagtgttgaggagtggagtcagtccactgaggaggtgcactgcatttgggttttgctcatgtgctttttctcacagcttcaggtttctgtagaactcattactttgtttgtaggttggggatgtcctcccgctagagcttttcctcagtgtctatttcacactcagcgttttcacatagcaccttggagtggctctcttctttatgcctttccccactatacttcttggatacttgttactgaactctcgctagtttggtggtagaaggagagggaagggaagtgtcttttcattcttagggagaatctcaggggtggagccttctctgatcctgccttgcttctggctgtaagtctgtgcccagtatgtattcctgcctttactaagagtttttccctgttctcttcacccagcctcatcgagtattcatccgtgccccatgggtagcagggttttgttgcccctgttcatcagtttcaggctgctgttccataggaaaggtagaaagaaggatgtgggctgggccctgagcccttcccacagggctgcttttccctcccacaagcctacatccagtcttccctgaccgcagtgtgttttcttttttctttgtcttgtgagtacacaggaggtctgtgggtcgagcctgtgaaatgtgctgcattctccttgtgtctgtagcccaggggttcgtctgttccactggctcatacttggctttctgcaaaattgataaaatttttagctaaattctttttactggtatctgttacattggcccccaactaaacaaccacttgcatcttgtttctcctttgagttttccatctttccttagacttttgggttagttggttgccttgcaaccttgcagctctctgaagggtctaagaaaagtcatgaatctacagcttgtcagtgttgttgttgttgtagggttggcagtagtattccttcagcattctacatacttaatggaagccgcctcccatttttggttaataaatttcaaaacttggaacaatgttagatttacaaaaacgtcagaaagaacagagtgttcctgtttattctttatatagcttttttttttttttttttttttgagttggagtctcggtctgtcacccaggctggagtgcagtggcacgatcttggctcactgcaacctctgcctcacgggttcaagcaatctcctgcctcagcctcctgagtagctgggattacaggcgtgcaccgccatgcccggctaatttttgtatttttagtagagacagggtttcaccatgttggccaggctggtctcgaactcctgacctcttgatccgcccgcctcggccccccacagtgctgggattataggtgtgagccaccacgcccagccttcttcatctagctttaacatctaatgttgacatcttacataacatggtatatatttgtcaaaactaagaaataaacattggtaccacactattaattgtactacagatttttattcagactttaccaggttttccactaatgtcctttttctgttctaaaatacaatccagaatagatacaaatccattcaacttcagtgttttaaattattgtttttcattatatgaagtgctgtgtggtttttgtcaaatctgttattttggttttaatcttcaagcttgtctttgtttctttaagtgataaaggcataatttaaaaggtgtgttgggttatttcagtgcctaaagtcttgtctgagtcacttgttttctgctgttcttgcttatggtactttctttccttgtttgctttgttatcttcctttgctgctggctgtgtttggttaagttatttgtggaaatcagttgaagcctcaggtgggagtgtctttctccggagaacatttctacctgttttagctgggccccttaaggctcctctagcgtgggccccacccaaacgagattctgagttgaaggtgaactgagccattcaggcagtgcagccagggttgcagatgcacgtgagacctgctcacctctcatttactttcaccctgagagtagagcctttggtgtttcgttcacttgtctgattctctcttcacagttctattagaaggtccatgggttttggtttctgtgcccttcatcttatgagtcttgtaaatcaaagttctgttttatgcttacttctgctttactgtgtttgcttaatttcagtcttaacatcttgccaactcttgggtacttttaaaataatgttatatccagctttttaagttgttttcagtaggaaggttgattcaaataacctagtctggttatgggctacgagaatagcctccctgttttttgtgggcaaaattccagccttttatgttcctagcgcagtgtggataacagactggcaggttcaagaggccgtgctgagcagctttcactgtaaggtcactgtcccaggtcgggtttctaagaatctggatggttgtttcatttcttaatatgtacgccctgtgagagcggatacatcttgctcaggttcttatgattcttttgtttctgaaggtgaattaagtaagtgacatggtagaatatgttaagtcaactttcgtgtggcttactagttctcatgaatctattccatgattgtatcagttcttattcagtattagtatttaagaaatgcagaattttgtttcaaaaaatatatttgtattataagttgtgaagaaatacatctccataattattgctgggacaatacagtattttcttaaggaacttattggttgtggatgcaaatgaagcatatttgtgataaaaataactaatagaagtcattttgttagactatgagctagtaaaacttatggcacaaacatggagacttaacactttttcttccagctttcacttaagttccttttcagataggaggcagcctggtggataagagtattggttttgaaattagattcaggtttaaatcccagatcttctgtttaatctttattttatttcaggtagattttctggataacttgctatagcttatacgtcagtacttgccacttcaattttatgttatggagagacggcttctttccttaaacctcacgaaccaacctctgctagcttctaagttttttcctgccacttctttacctctctcagccttcagagaattaaagggagttagggccttgctctggattaggatttgctttaagggagtgttgtggctggtttgatgttttatctagagcactcaaactttctccatatcagcaataaggctgttttgctttctaatcattcatgtgttcagtgaagtagcacttttaattctctttaagaacttttcctttgcatccgcaacttggctgtttagtggaaaggacctagcttttgacctaccttggctttcaacataccttcctcactaagccatttctagctattgatgtaaagtgagagacatgcaactcttcctttcactggaacgcttagcagccattgtagggttattaattggcctaatttcaatattgttgtgtctcagggaatagggaaacccaaggggcggtagagagaaagagagacaggagaacaggccatcattggagcagtcagaacacacacgacatttatcaattaaatttgtcatcttatatgggtgcaattcatggcacccccaaacaattacaatagtaacatcagagatcacagatcacaataacagatataataatatgaaatattgtgagattaccgaaatatgacacagagacgtgaggtgagcacatactgttggaaaaatggcaccaatagacttgctcgatgcagggttgtcataaaccttcaatgggaaaaaaatgcaatttccgtgaagctcagtaaagcgaagcatgataaaatgagatgagcctgtcactcctaagaatgttcctgtacaagttttttgcatctgttacttaccttttcctatttgtgaatagtatcttttttgagtacgtgtgtttttttatttttatacatttatatgtatcttttgaagaacatacttttaagcttaatttattgattttttttctctcataatttccactttttgtatcctatttaagaagtccttgccaaacttaaggttgctaagattttctcctttgttttcttctggaaattttagagttttgcttttacatttagttctaggatttatttataattaatgttttcatatggtgtaagatcgaagttcatatttttttaatataggtaaccatcactatagaaaagattatttccccccaatgtttgaaataagtagactgaatatagatgggtctgttatccctagatcaatggagcatttgttctgttatattgatctatatatatatatccttatgccaataccatactgtcttaataatgcttgctttgcagtaagtttttaaatagtgtagttgtcttctaaatttgttctttcttttcaaagttgttttggctattttaggttttttgcatttctgtgtgaattatagaattagctcgacaatttctacccaaagtttgtgggcttttcattttgattgtattgaagatatagatgaatttgggaagaattgatataacaggattgaatctttggattcatgaacgtagcctgcatttgtttacttaggtcttctttatttatctcagtgtgttttgtagtttaatgtacagatttgcacatcttttgccagatatatccctaagaatttcagtttttgatactattgtagatgacatttaaaaaaatttcaagtttttgtttgttgacctaggcatatatttgactttttaatatactaaccttgctaaacttatttatcatctagtaacttacaaaatatattccttaggatttcctacataaacaatcatgtcattgttttagaaataacagttttactttgtcctttttaatcttgatggcttttatttctttttcttgctaaattttctggctagacctcctagtacagccttgactagaactggtgtgagggaaatcctttccatattcctcatctttagggaaaagcactcattcttttatccattctttagttcctagccccattgcccttcctaaattttttctcatcattttccttcatcacaccttgttctttttctttgcaatcatatcatgatatgtaacgacatgtttttatttatctgtttaatgtatttcttttcctcacttgtccatgaagggaaggaccatatgtgttgttatcctttgtgcagttcctggaacataataagtatataagaaatagtttctgaattagctgtgaatgaattcatgccttcctgctgtctgtcaatgttcttttaaattaaacatctaagacagcaaataataccacatgagttattaacctgagaaataatcgttttatttataaatgactgagttgaaagctgatagcccacagtaattgctttcatggctttgaatataaaccttactgttacaaaacacattttcatgaaaatgaatgtgtggtgtttggaactagctttaatgtttgtcttcctgtttttccttctagttgctataatataataaggaattttgtatgtttttcctaattgtacccacttttctacattttcttaacagatctggtgaatcttcattattaaatataattatacatataaattattgtttaataataatattaattattaaaaataatataaattattaaatataaagatacatataatattatctgttaatttctaagttaggtgtgggttctgaagactattatatgaatgaacaaaaagcttgcatatttgcgtggaagctgaaagtacgaaatttttagataccattataccagtatctaaagaaaaaattcagtaccacataggtttttaagtaggagctgtatgatcataggtcatccagatgaaggaaggcttctgtaccagacgtacagaggtagacagtgttgtctgagtactgtctgagatctggcaagaatgaatccaataaacgtagttttctcccatgagctcctgtcttgtttcctgtattctgtttgtatttgaaaagatttggtgtgcataacttatttttgtcttttggctgtcaatcaaagttattagtgtagtttttgtaactcagttctcaagctaggagtttttgctgtataattttaatgtttctgtttttactttcctaagcagataagcgtaaaaacttagactaattgattacttattaaacgtccagcttgatattcttctttatattattttagtttcagtttatataacaaatgaggtttcttataaataaaatttaaaatgcactaaaggagctgtgtgaaataggaattctgtgtgaagcttttgaatgtgaacatttagaacgtttcacatggtgggaatttactatatgattttcatcaaatgaggtactttttagtgttggtacttaacgatactgatttctaaaatttgtatttctaaaaatgacgtattacaggatctgaaagggcaaaaactcattgaggctttgtatgagtcagcgtttcatggcctatttttaattagtgaattattagcatataattagaaatgtttttagattcttcatggctgacctaccaatgaatgtagcactgcatttaaaatatagttcacgttatgttcatacttaattgttgcattttgtttgcccctcttgaaacgaaggtcacatgtaaataaatatacattttctcctactgtaggaaatactctgttagcattagtaggtttagcttttttaggttaacaataacaaaaacaaagctcacacaaaataaaccaaatttgctctatgtcccacagatgtatcttgtgatttttccagaaggtacaaggtataatccagagcaaacaaaagtcctttcagctagtcaggcatttgctgcccaacgtggtaagtaaaaatttgagtgtttgaacaaataattttcaaagataataacatttttagtttttcttcctggaaaagatacttttgttttacagttgaaggaatgaatgtattcattccttgaattagtgtacatattatctcttaggaaatgaagtttcttctccttaattcactttcatgctattattacatatatctgagaaattaagttgaagtgcttgttacgatacatattcttgtgccatggatttatttaaaatctatctaagtacatgattatgtagatggaagctttttctacagtgtatgggttatatgtaatggagcttctgttttgtaagatgacagacctaagttggagtccaaactcgtacttttattagctgtatggttgcaacttggaagttgtgtaatgttgctgagcttgcttcttcatctcttaaaagaacatatgccttataagtagatctaaatctgtgtgaggattagattagaaaatatgtcaagtttctattggagaagttacacaaagttggtccacagtgcttggaagctgttaatgtcttcaacaatggtaatgttcttaatatccatattttagaaaattgaataattggtacaccaataagctatgcaatttaaccaaattgggaagtatacagaaaacagtggctatgctatgttcttagaggtgtctttgaagcttgactgtgatttagtgtgtgatctccatatgttgatagtcactcactgagcaaataccttgttggtgacattacagcagggcctatgacagtgctgtctaatggaactttctgcaataatggtaaagttcttcatctgttctgtccagtgtgctggctcctaccaatgtggtttttgagcattcaacatgtgactagtgcatgaaactaatttttaattttatttaattttagtttaattaaaaataagggggagtttttacaaggtgcttacaagagcagatatgtcataggtatatgacatcatttgtaacagtacttttaaaaaatgccagtttgtttttaaacacatgtcctattaagtaaggagtgcttcagaataggagggttcagttggtctccccatctgccagctctcttttgactttcattgcttcctctgtctaatagacatgacgttctgtcatttcagttgctcttttgcaatgccattgtctcttttgcccttttcacatttattaaacagaacaaaacaaaaaccactctcgaatctgtagtctacctttgttgtaagcactttttccagtactcactctgccctcaatttgttttggtctgatttgaaattctctccctagacttctgtggggctgttctccattatcctcccaactctctggcgattacttcctagcctcctttccagcctctttctgcttcatttctccctgctacatgtgttatttccagtgtcaggttttggtgtttgattaatttcactttttgtttctcatggtggccttcctctaaatccatggctttagccatcgtttccttgactgctgatgactcgcaaaagcttcctcccctccatgtctctctgcctaactctggacccatttgtacaattgtccattagagagcttcgcttgactggcccaaaaggatgtctcaaactcagcatattgaagatagaatttatccttccatgcatacactcatatttcttgtcttggtaactccatcattcagtttttttgcctaagttttattcacaaaaagaacaaattgatagcagttgcatacctcttataggaaacttagacatggaggaagaagctgttcagatggggtcctgcagaagtgcaggcactgtggtaatatttaaacttttctcagctgttcgaagggttttgttttaactaattttccttagacttgttttaggtatttggctttctaatggttataagggatgtggaattaaatgtatcttaatctgccacctggacccattaaagtaagcccctatggtggtttttttttttaattgccatggttaaaaccatagttgctagcgaaggtgacatacttaagctttttgaactctcttaaaagaaaacagaaatttaatgatgtgtctataatggcaaaccagatacctagaatttccatgttattcatagggtgaataacactggcgattgtagagatttgagagttctttcaaaacaggagaacaaagggaataagctacaaagcaatttttttctttgtagacttaactgaataaaaattatttttatgtctcaaacatcatatgaacaaatttagttggcaaatggcaagctaataatattttataatataggatattaatatacttaatattacaaaagtgcttcataattagaaaagacataaactagaaaaatgggaaaagggcatgaataagaaattcaagagatacaaatgacccacacacttgaacaaatgtttattctttctcataatcaaagaagtagaaattaaatgaatactttgaagccaacttctgagaaagcatagcaaacaagaaagctagtgctcagctttgtgtggtaacggcactctcgctcttaagaaggtgtgtttgctccctgtggctgctctcaggcagggccacaaacttggtggcttaaaacaccacagatttcttctcttacatttgagaagtctgaaatgggtcttactcagctgaaatcaaggtgttggcagggctgcagtcctttgtggaggcttggggggatcttgttctcctgtacggggtcctgtgcttggttcggggtcctgtgcttggtctgggatcctgtgcttggttcgaggtcctgtgctgggtccagtgctctgcttttaccaccttgaagttcatctggaaatggcactggctcgcccacaccatatagctgactctggttctccctcctcctcactcgctctaaacctgtgtttttggctgatttctaatctctctttccttggcccttctgcagcttgcagggccttctgcagctcttgtctgccccagccccggggtctgcccatcccagtgctgggctgttctgttcctgccctgcctttcctcagcccttggcaaccctgtttgttttctcccttccttagcagtggagaacatcgtaagatcaatgctgactgccttctgcagccaagccaggccatttcatttcagccgagccaagtctgtgtggagcagttcttttatttttctccttttgactacctcatggttttcacggatttttgttctcttcacattcaaggattttttgctttcagaaagttatatttctctggaaagagtgcacccaatatcccttttgatttcaaaatcttaatgtggagtctcttgacttggatttctttggaagaaactgctgaagctgccatgtctaagaagaaaactttggagaaaaattttcttcttagacatggcaacgtcaacagtttctaagctcttgattccgtctaccctgtctccatcgttgcctcagtcatctgccttacttctctgcaggggtttctcccagcttgcaaatgtactccaattctgaaataactaagtctatagctgtgcaaagagaagtctgggccccttgctttcttgtgtttgactccatccactctccagaaatgaatcccacttctcacttaaccactgacctccaaagcatcgtatcatttgtgtcagttgtcatatttgttaactttcacataacttttgacattatttatacctttataaccaggaaataattttaactttattgtagaaataaacaatggagtataatttttcttgttgaagataaatatcacctcctcttcctttaaacatctcttccctttgtttttgtattacattggtttcccccctttttttatttcctgggttgtcgtattccctgttattatttttacctttttttttttaatgtggatgtttccggagtctgtatttcttgccttttcatcttctgccctttattattctcagccactgccattacttcagttatccattcccatggtttccacatgcttagcttcggttgattcttgccattttacagaccatatttccaactacttctagaatgttttgttccttcagcctcagtatgcccaatttgaactcatgttctctctcccccttctttcttccttctttctttcgctctctctcccttccttcttttctttccctccctccctttcttccttccctcactcgttctctcttgcttgcttgctttctctcctctctctcttttctttctgctttctttctattcttctccctccctctcttccttctctcccccactccccaacttccaggctaaagcagtcctcctgagtagttaggactacagacatacacgtgccaccgcgcccagctccgtgttctctttgtttccctgcctcctgctcttccacttatctttgcatggcaggtgggtgcacgcaggcatgctctgcatgtcttcctcttggccattccccttctagttatggtgtggctttatctacgcgttctggagcagaagcctagtcacaaagctatttttttaaaacattcatgataattcatttccttttatgttttaaaaatactagctttctgtctttatttccttactaacttacttggatgccagtaattagttgttttagtgaacaccacagagtgatattttgaaactttggacttcataaagttggatgagctccagtagcaaagaaggaagtgttaactagtttaactgacaaataaatgcttcccagcttggtgtgcgattgagatttttgttgcaagtttgtgaatcaatttaactgcccctgccctggggactaaagtcagatacgtgcttgtgggaatctttgtctttcccacaccaccctgcattttaaaacctcttgtgtgggacagtcccaccatgtaatagctgttcttccttactcagctactttccctccagagaggccagtagaaaatctagactagttttttatagtctattttcatgtcacttattgagagctactgttttctgttaaattgtcagtaaatattttaatcaaggaaaagggaggcaataggaaggagagaagaacaaatccttaaccctagtaggaacctaatgaatgggatttgttctggataattgcagtagtcccccagctaaagaaccttttaaaaatatgtcagatatacccaagaggattgaaatcgtatgttcatacaaaagcttgttcacctgcagccttcatatgcaattcctatgaatgttcatagcagcattattcataatagccaaagtatggatgcaacccaaatgtccatgaagcaattaataggtaaacaaaatgtgatctgttcacacagtggaatactaactattcagccataaaaaggaatgaagcactgagtcctgcagccacacagatgaacctcagatccatgctgagcgaaagaagccagaaacaggaggccatgtgctgtgtgactgtatttctaggaaatcttgagtcaccatgggcaagatgctatcacctttgttcagtggccagaagcgagggcactaatatttacccttgccggggtctactagattgaagcgtttccgctaggccataaacttccaacacggtgacttgtacatgtagatatttgatcaatatatagcaaatgaatattgatttaaacagaaaaaggcaagtgagagtgctttctaaacttagagccctaaatatatgaggttgtggaattaatagattctgttgtgtgtgtttgagggaatttaaaaataatttagatgttaaacagtatattgtggaggtgttttgtaactaattaatgacggcactgaattgacttctaggccttgcagtattaaaacatgtgctaacaccacgaataaaggcaactcacgttgcttttgattgcatgaagaattatttagatgcaatttatgatgttacggtggtttatgaagggaaagacgatggagggcagcgaagagagtcaccgaccatgacgggtaagtgtgttcacgcacctgaaatgcctgtacacggtatatacagtgcacatgtttatgtagaattcagttttacaaagtaggttaagtgtacttttttcctccattacatttacccggtatatttttcaagatgttattaagatgtaacagtggagatttcattagtcctgcaaagtgtggtatttcttggctgtcgtgtgagtcctgtggactcaccaattatcattaatccagcctctttctactcaaagttcacacttaaaaggaaagctctgtaaaagggaggaagacgtgaagaaggagcacgcctggcagtactgagtgcacgttattagtcagtgctgcccttttgctgtatttttcgtaaaatatttattaaatttgggtgtcattgtgacaagaagaaatgcagttaagtgtgacctttttttttccccaaacatgttaggttttaagaacctttgagctattgtcagatataaccagaaaaaaatagaattttaagtgagcaggataacttagttaaactaaccaaacatagtgttagctgttagagaaatgtaaacatggaaataggcaaacagggaagtgtgtggagtttctgtttccttttcaaaatatctgtttgagctggggttgagagagaacactaggcttcatggggtttttttgtttttcgttttttgttttgagacaagagtttcgctctgtcgcccaggctggagtgcagtggcgcaatcttggctcactgcaacctccgcctcccacgttcacacgattctcctgccttagcctcctgagtagctggaactacatgcgtgtgccaccatgcatgactaatatttgtatttttagtagatatgggatttcaccttgttggccaggctggtctcaaactccttacctcaggtgatccacgcacctcggcctcccaaatgagctttgtgtttttacctcatcagctgtttggggttgagccactatgtatgtcagtgtgcttgtatcagtaggatctactgagggcagatgttcaaaatatgagcctccagcacgttttacatggaaaccctcacctgaagcattcgtctgaagttgatgtgccttggaaattttatagagtaatatttttaactacaacaaaacatttataaaagtagacattattaaagcattcagaagtgagcaaggatagaaattattctgcccaaccttacacgtaggccttctagacgtagtactgtgcaccgttacattatctaacactgtctgtgtgtcatctttggatgttagggatttttccaaagttcagtgagattatagttgtcaaatgattagtctgttaaataatgataagatgagggtcactcaggttttaaaagaaaagctctttgactgaaagagagagcagctgtctactgcagaaagttagggagggaggctggaggagtgaggcccaggggctagctagtataaaaattggttatggtcgaaggaaaaaaaaatgtaacatatttatatctgaaagatgattgttctcataattgtatataacacagagtaattgtaaagtagaaaactaaggtgtttttcattttagatgtaaatgtttagaatatgtaatgcatcagtttaaaaattaaaactgtacgaaatgcacagtgaaacgtcttccttgctttccaccctgctacctggccttcccttctccttcctagcgataaccagttttcttaatttgttgtgcgttgtatgtgcaaatttaagtatatcttcttattctaccatccctcccttcttacagaaaagtggcatattaatatttttctcttttaaactatcgaaggagttacttacctatttttgcatttcaaaacagacagttcatcaagattgtcgttggtttattaaacatagtttaagattaaacaagtgtttataaccaatgaaaaacagatagactccccataataaccttgtttaaatgctgctacttttatcatgtcccctcctgtctaagaaccccttggttcagcagagctcatgggtaaggccagcctctgttgcctgccatcggaggaatgcgttccagccgtgatctctgccttgccttcgcttcctcctgtgctgtgccgtgaagcctcggccgtggtgaagctggctgactgagtcctcctgcaccccatgcatattcagtagttgaaggctttgtgtggccaatcctgctttccacaggaaaccaccctctcttttgttgccctcatccaaggctactgttctcccagagtgacaggcggcacctttcccagcatagcactgtgccttctcctgcccctgctcttgcagtactgctgtggcactgatggcgtgtgttacagtgctggcacttagcacagggctctgcctttctctcttcccagccgcatcataagtgccttgaggaagccaaaaccttctgtgagttgcattgcctgggttccaacctcccactgccctgcttatcctctgctacatgtgagctgactgtggctttggggtggtcactgcctatgtgtattcattacaaattgtctccttttgaaagattgacctttctgacttacccagataccataaagaaaataaaatcttatcacttcagtcaaggataaagtatttctgaattaaaggaaaaatacaccagagtaaaatcaagactgaaagacaaactgggaaattatttgcaacctagatcatagaaaaggggtcatttccttcttgcgtaaagtgcacttacaaattgataagaagatgactgataactagaaagaaaaatgggtaaagaacaacaatagacatttcacatttaacctcattcatgataaggtaagtgcaaatgaaaactacaggggatacctttttttttttttaatccattagattggcaaacatcccaaggtttgatcataggctcagtgggtgagatttaagtattatcaggcatttttatactttgctgttaggaatgcaatgtagtacaaacctttgtagaagttgctttggaaatgtctctcagatgtacaaatgcattcacattttagatttagcattcccgctttctgagacattattcaacatgtatacgtgtgcacataagatataataataacacgtttttccttctagtgtgttgcttttaacctgtagcttgaaaaaactctgctttcattgtttttttttgttttctgtcactggctcagccctgctttcaattgtttatatgaattgatgggtgttctggtctggttataatctactttagtttaagagtcactttaaattatatgacatctgatataagttgtgttaggtagaaaattctgtaacttggaatactgtaagtactttgtggccacatttcattagtattaaatattatctctatatatagtaggctatttaatattcatattttatgatgcaattaagaaataatttttttctgaagttggtagattgttgatatgccatggcccagtgtttctcaaagcattctgggggatcactgtttgtcagaattagctgcagtgattgttgaacatgcagggcctctgctccactccacgttgctaccaggacgctctgcaggtgagagctgggaagctgtagaagctgcagtgctaacaaatgctacaggaattcttgtagtcaccttcatgaggtcttatgttgaggagaggcagccagtagtgtcccttgtccttcccgttttatggtgtaagtttcattttaagggaggtataaatcaaagcccacctgggcattctctcatggttcactgcttcttgtaatcatggaagatgtcattgcggcagagacgaaacagtgtagtttgattactattgatttttttttaattatttttctgaagtggctgttgtaatgtaataaattgtgtgcttaaggacaacctttggtattctatttgagtattgtgtatgatcctagttaagttttttctaccagtattttcatattacaacatatttactttccatttctattaatatttttatatttaaagtatggaggccgggcacagtggctcacgcgtgtaatcccagcattttgggatgctgaggcgggtggatcacaaggtcaggagttctagaccagcgtgaccaacacggtgaaatcccatctctactaaaaatacaaaaattagccgggcacagtggtaggcacctgtaattccagctactcaggaggctgaggtaggagaatcacttgaatccgggaggcagcagttgcagtgagctaagatcgtgccactggactctagcctggctgacagagcaagaatccgcctaaaaaaaaagggatcagggaagaggggattacagataacccaaagaagaaggaaaaatctccacaagttcacctgtccagcggtaaccccaatttggatattttcctttaacaatttggatattttcctttaaatcctcttttttataatgtctatatgttggagagagtatgtgcctttacgtattttttaaagatgagatttctgtgtgtgtctatatctcctgttcttcatattttcttgtgtgttataaacagctgtacatgtcagtatatatacttccgtaacttttttttaaaggctatatagtgttcattgatgtgatttaacagcagttatctccccggcttcatcttgttggaatgtgggtcctgtgtgttgccttcagagcaaatggggcttggttttgcagcaagtagacctgtgacctgtacgaatagttggaagactttctctattacccaagcgtatcagtatactttagtgcctactagaaatttatgggtagaaaaacaataatatcttagagtattttttcctagattccctaaggtgctatagggtgatttttactcatgtaacatgaactatgcttcaactaagatagtttttgcaaatgtggatatataagtactttattaaacctataggaagtatttataccacttatttcctcccttcagtgttagaacctcctaaatggcatttgacattgaactgctttccactttgtcgcatgctcctctcattgtccctacctgggtcctgaaccttagggacttggctgttatagccccaccatggctacgctgggccttggtcgtctctgagacttagtttcttcatcttacaaggagataataacagcccctgcctgcgtagaattgcagagatcaaatgaaataattaacatactcaaaagcatgccgtaaacacattctgagcacatgtacgttttaggaaaaacaaaaggacccatgcacatttcggagtgcttttgtctcagcagcactgcctcttcttccaaagctgacgtcttagtagaggccctgccacgtcctgagcactgtactccacgaagcattctatttctgacattcgaaatgcagtctgttccatcttccttacaatctgtatgccagcacttgaaataccgggtatctgcagtgttgaccaggtgattacttaattatggaaatgttgaggtggagatctagataattcagtgaaggcaggaaaattggtgtcggaatctgtctttttatgtgtcagaaatagaaataagatagggtgagaagtaatttgtggctaaaacactataatagctaacacatagtgcatactgtgtgccaagcactcctgtaggtgcttgaaatcttctattattattatccctactttatagacttgcacccttaggcacagagaggcggacagttgtccaaggttaccccagaggtggagatccaggctacctgactccaccatgtgtgctcttccctagggcacagttgtgctgctaaaaatactttttaagcagttctttgattattcagatgatagtactgtaggaaaattaagacaaaaataatgaaaaattaaaatctttattttagtgttttgcacatgtattattaaagccagtttactcctggaagtgtgtaagaatacagggtatttttgatcacctaaatgctgcatgttactaagagctcgacactgaagtcaagaagagcagttgcagagagtacttagcaaaaacgggaagtgtgtggggttgaaggagcaaagacaagtcttcctcggacggtggagtgtagaattcatcatttctcagaacacgtctttgaacgcattttcaatttgaggccaaaggtctcagcctcccactcggcatacctccctaccttagtcagctcttaaatcttaggaatatttctttgttcttcaaggaacttaaatatgttaacattcttacctgtccacagggagccccctacaaagaagggagtttctagtctccgttctttcttggaataaataatagcctcataccttgtgcaatcgaggctgaaaaagactgtctccttttttcaaataagcaagtcttagaaactacagttgtttacagggctcatggctattccacagtaataattttggttcttttaccaattatataatatgttaaaatatggcaagtatcaggaaagcaaggagtggcaatgattagaaaccaatggccaagttagagaggaggggcaattgctcccccaagtttgttgtggctgtgtagcagtcagtgacgagaagctgtgtgtcaggcgacaagcaaagttgaggattatcaggcgcctgtgagtgcccagctgtgtgccaggtcaggaggtgccatcgtgagccagaccagcttcctctcggcccctgtggagctcgcagtctggtggggaggcagcagtcaccatggtgacaggtgacacactaggatggggctggtggtggtaggcatttgcgggtcccttcagagaggtgagtatggacttagaggaggctccagcttcctattcctgggctgtctatagcactaaaagttgtcacatgaaaaataacatttggtactattgatttaacttaatgacttatgtaattgtagttgacttagaaattataacatgctcttctacttcagcttgaaacccccaaccaccagtttataatcctttttttttaacttttgtttatttttcctaaggaatctgtactttttcttcattttacaactttttttgtcctgttaccttattttcatttttactttatatgaccatgagttctaaaatagtaaaaaaaaagaattatttttgttctttgttagaatttctctgcaaagaatgtccaaaaattcatattcacattgatcgtatcgacaaaaaagatgtcccagaagaacaagaacatatgagaagatggctgcatgaacgtttcgaaatcaaagataagtgagtaacaacagttccagcacttccggaacttcggttcaactagatttcagtatagtcaacaatttgaaaccaatgtaaatggttatattgtctcaagaatacattttataaattcaaatcaaattttatgcatgtctgatcgtgttttaaactttacttgtacaaatcagtctaaaagaacttgttacagtgggcccatctacttgcattgatagtatttcttggacaatactacgtgataacatagcaaattaaattaaaaacaacaacaaacacacaaaaaaactttccagtgtcagatgcccggacctacctgtcaggtcacataaagtggtgttactgtgtgaggtctggctgttgggccagtgtgcgcagaaaagcaagggaggggtagaggactatgcggacgtgcaggtggacatgatgctgttatatttgttggaaatagaagggggcagttgacagcgttatatccaaagtgtcttctgtggttaattatattcagaaattttagccaattgttttattctctaaatatgtactttctgctcaagaaactatcattgttcttcttttccttgttttacagtacagtgtttttaattaaccctcctgggttaactttaccaggtgaaaatgattaaaagtgtaataggttaacaatgaaactttaagcttctatttttcattgactcttaactgtacatgatgtaatgtattcagcgagccattcaggaccactttggcccatggaagaaatttaaaagtaagatctacatgtattgacatgaaaatatgttctcagaaaaaagactaatgtatttaatgtcctacttattttataagtatttagaatacctctggacattttaaaacaatgattattgctagggtgtgtgatttataaagcaatagaagcgctttccctttctgtttgtgttttagattattatatcgggtatgttctgctatcataactttacaaatcttatgtaatatgggaaaatgagttaactatgctgttttccttcttttacctgcctttctaattctgtgggaataaaggcgtttttgagacagcccaggtgtagtgagcagtccatatccatggattccacattcatggattccaccaagcacagaccaaaaatactcagaaaaaaagggggctggctgtggtggctcatgcatgtaatcccagcactttgggaggctaaggcaggcaaattgcttgagcccagaagttcaagacagcctgggcaacatggcaaaaccctgtctctacagaaaatacaaaaattagccaggcgtgcacctgtagtcccagctactcaggaggccgaggtgcgaggatcacctgagcctggaaggttgagactgcagtgagctatcattgtgccaactccagcctggtaacagagtgccttttttcaaaaaaaaaaaaaaaaaaggatttgggaggatatgcatatgttatattcaaatacatgccattttattcatatatcagggacttgagcatcctttgatcttggtctctgccgggtatcctgggaccagccccctgtcgatacagagggaccgctgtctaagaaccgctggtcctatctttgacttctggcggaataggagctccatgtaaaaaggaggagaagctgcagcgggttattagccatttgtgagtcaggtcactgtaaaactttatcaaaagtttaaaagacaaaaagcatcctcataaaatgccttaaaaccacctgttgaaatattacatatacaattcatgtatactaatcatagagcatattaaagatattttagaagactagaaacttctattaaaccaagtttctggatgtttccgtattcatccttattttccagggacctgcataacttttccagcgtgtaatagctacctgattgatattttttgaattgaaatactgaagtgactaaaatctaaactttttccattctggccataggatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacgctattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgtagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaattcgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctatttttgtgttataatttaaacttcgatttcctcatagtcctttaagttgacatttctgcttactgctactggatttttgctgcagaaatatatcagtggcccacattaaacataccagttggatcatgataagcaaaatgaaagaaataatgattaagggaaaattaagtgactgtgttacactgcttctcccatgccagagaataaactctttcaagcatcatctttgaagagtcgtgtggtgtgaattggtttgtgtacattagaatgtatgcacacatccatggacactcaggatatagttggcctaataatcggggcatgggtaaaacttatgaaaatttcctcatgctgaattgtaattttctcttacctgtaaagtaaaatttagatcaattccatgtctttgttaagtacagggatttaatatattttgaatataatgggtatgttctaaatttgaactttgagaggcaatactgttggaattatgtggattctaactcattttaacaaggtagcctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattgcagtgagccatggacataccactgcactacagcctaggtaacagcacgagaccccaactcttagaaaatgaaaaggaaatatagaaatataaaatttgcttattatagacacacagtaactcccagatatgtaccacaaaaaatgtgaaaagagagagaaatgtctaccaaagcagtattttgtgtgtataattgcaagcgcatagtaaaataattttaaccttaatttgtttttagtagtgtttagattgaagattgagtgaaatattttcttggcagatattccgtatctggtggaaagctacaatgcaatgtcgttgtagttttgcatggcttgctttataaacaagattttttctccctccttttgggccagttttcattacgagtaactcacactttttgattaaagaacttgaaattacgttatcacttagtataattgacattatatagagactatgtaacatgcaatcattagaatcaaaattagtactttggtcaaaatatttacaacattcacatacttgtcaaatattcatgtaattaactgaatttaaaaccttcaactattatgaagtgctcgtctgtacaatcgctaatttactcagtttagagtagctacaactcttcgatactatcatcaatatttgacatcttttccaatttgtgtatgaaaagtaaatctattcctgtagcaactggggagtcatatatgaggtcaaagacatataccttgttattataatatgtatactataataatagctggttatcctgagcaggggaaaaggttatttttaggaaaaccacttcaaatagaaagctgaagtacttctaatatactgagggaagtataatatgtggaacaaactctcaacaaaatgtttattgatgttgatgaaacagatcagtttttccatccggattattattggttcatgattttatatgtgaatatgtaagatatgttctgcaattttataaatgttcatgtctttttttaaaaaaggtgctattgaaattctgtgtctccagcaggcaagaatacttgactaactctttttgtctctttatggtattttcagaataaagtctgacttgtgtttttgagattattggtgcctcattaattcagcaataaaggaaaatatgcatctcaaaaattggtgataaaaagttatttcttgtatatgtgataaagtttacatgttgtgtatatatgttgtattgccaaatacggctattaaatactacgtcatattttaaaggttcagtttgtagtgatagtaaacaagcagtgcactaagcctcttgcgggcatcatctcatctcactgtcatcacaaaccccatgccacagcgtagcttgaccactaaaagtaatgcatctgcaagcatactgccaggttttggatagtttgtaccaacagttaccttatcaaggtaaatcccagactctaaaagagttggtgctgtgtcactacatgcataactttaaataaatttcctgccgggcgcggtggctcacgcctgtaatcccagcagtttgggaggccgaggcaagtggatcacttgaggtcaggagtttgagaccagcctggccaacgtggtgaaaccctgtctctactaaaaatacaaaaattagccaggcgtgtggtggcaggcacctgtaatcccagctacttgggaggatgaggcaggagaatcatttgaatcctgcaggcggaggttgcagtgagccaagatggcgtcattgcactccagcctgggcgacaagagcgagactccgtattaaaaaaaaaaaaaaaaaaaaaaaaaaattcctctcctgtttgagctttcccttacctgtaaagaggggagaatatgtatttacttcaaagagttcagggaaatgactctcactagtttgagattctaggtataaaaatacattcttatataattttaacaccaatgtgagagattattattcttgctaaaccaattcagttttatttgctgtctaaaatgtgtgaataagtaattgtccattattttctgaagtgttttggaactcaacacatgattgtgaggaggatttgttgctaaacatctttctggttattcaagctcgtgtatactgtgctctgttgagacatgcagagttactttctgtctgggtcacaggtcagttcttgatagttttcggacaattaaccagttttcatttgcccatgaccacctttattctttttcctcaactgcacccatcttttataaggtctttcagtttattgcagagaagatggtggagaaaagccggaattcccacccaccgctgccatccccatgttttatcattggctagagtggaaaatagcagtaactactgtgagagatcatttgtttatataatggaaacaaagatgaggaaagaacctggcttagatcagagaactgatgtatttagattctttttttttttttttttaagacggagtgttgctctgttgcccagactggagtacagtggctcaatctcggctcactgcaacctccatttccctggttcaagcaattatcctgcctcagcctcccaagtatttgggattacaggcgtgttccaccacacctggctaattttttgtatttttagtagagacggggtttcgccatgttggccaggctggtctcgaaatcctgacctcagatgatccacccgccttggcctcccaaagtgctgggattacaggcgcgagccaccgcgcctggcccaatgtatttggattcttaaagaacactttcaaattaaatatcagttgaagagaactagaactaaagaatttctgtgtcaaactgtttagcaaatgtaagtagaagctgggagatgtgtcctggaatgaatgaatacatcagtaaaataccatacgtatgttatgatgttattgtttccttgccttggttgatttggttttactgtgaaataattttcaatatagaattgtgatcgttggaatttggtcatctactagaaaatgagaaagaagttaatagctatcttccttaaagatttctgaggttgggattaaggtagtgttcccaaggtgttctaaaacggcagcgagagctgtgcactcacttcacaaatttgaattcctgctctgtgttaggcgctgtgctagg

SEQ ID NO: 180 - DNA, 2000 bp, Homo sapiens
gtggatctgtgactgttcgcaggaagagaggagcgggagcaggacagacaataactgatagtcaggagctgggtttggagataaagagggaacaagagaaagttaagttctgtgttttcatggcaaacattgcacaaaagtttacaacttcgtgactaacagtaatctggggtgattcacaacaaatttacacataaacacatatttactgactttatacacagcaatcctaacgtgaacacagaacctgctttatcttttcgcacactgttctagtgtagagatgtctggtctcagttaaagaaagcataaggagcattagttgtgcacactgtccacacccgtgacttttttccaccagtactaaacctagtgcttcttacagtacagggcaatgacagccacagaaagagagaagctccttttactgtgtaatgcttcctgctggccttcaaatacttgttacttgagagatctccattcacctggctttgtccccaaaggtcatcatctaccaatgatgttgttatttgatgttaatcatgtataaagaaagtagctaccatcctggccctgattagaacttcccactgaaataccgtcctgcctaaaggtagcacaggtttccattatggtggtggtggggagggggcgggaatatatatatatatatatatatatatatatatggtaaagcattcggcattcttttaaagtacaactatccttgaaaagggttacatattaaaccatttttaccacagccaaaggggaggagaaagatccaaaagtcctgtggatctgctttaacatcaataaaacagttatccacccttcgtagcttttagtgaaggctacaaaagtatgctttttatggattacacatgtgcacgcaactactttaattactacagaaaaaaacgaggctccttattaaaaaaaaatcagaaacaagtccaacagactctgaggaaatgaagcaagagtgaattctgaaaaggtctaataaacagtatggaaatatccttgtgggattgttcttcagctatgcataaacatgtaattatcatcattactgtgatggggaaaaacacggaccctaattctgaaacaccctggtagcgagagacgggcaggaggggctgctgcgcactcagagcggaggctgaggaggcggcgtccccttgcaaaggactggcagtgagcagatggggacactcgagctgccccgcgacctgggccgagctgcctacaacctgggcccaggtgcctgcaagaattagacctccgataacgttaacacccactttctcactgctctaattgtgtgcatcccggcgcccaggggcttgtgagcagcaggtgcgcgttccaggcagctccagcgacccttaaacctgaccgcgcgcacgtccggcccgagggagcagaacaagaggcacccggaccctcctccggccagcacccaccttcacccagttccgtcagtcgccaccacctcccttcccgcgtccgcagccggcccagctggggagcatgcgcagtggccggagccgggttgcccgcgccacagcaggtagctgtactgcaactgtcggcccaaaccaaccaatcaagagacgtgttattgccgccgaggtggaactatggcaacgggcgaccaatcagaaggcgcgttgttgccgcggagccccctgccccggcagggggatgtggcgatgggtgagggtcatggggtgtgagcatccctgagccatcgatccgggagggccgcgggttcccttgctttgccgccgggagcggcgcacgcagccccgcactcgcctacccggccccgggcggcggcgcggcccatgcggctgggggcggaggctgggagcgggtggcgggcgcggcggcccgggcccgggcggtgattggccgcctgctggccgcgactgaggcccgggaggcgggcggggagcgcaggcggagctcgctgccgccgagctgagaagatg

SEQ ID NO: 181 - DNA, 1901 bp, Homo sapiens
taaaggttcagtttgtagtgatagtaaacaagcagtgcactaagcctcttgcgggcatcatctcatctcactgtcatcacaaaccccatgccacagcgtagcttgaccactaaaagtaatgcatctgcaagcatactgccaggttttggatagtttgtaccaacagttaccttatcaaggtaaatcccagactctaaaagagttggtgctgtgtcactacatgcataactttaaataaatttcctgccgggcgcggtggctcacgcctgtaatcccagcagtttgggaggccgaggcaagtggatcacttgaggtcaggagtttgagaccagcctggccaacgtggtgaaaccctgtctctactaaaaatacaaaaattagccaggcgtgtggtggcaggcacctgtaatcccagctacttgggaggatgaggcaggagaatcatttgaatcctgcaggcggaggttgcagtgagccaagatggcgtcattgcactccagcctgggcgacaagagcgagactccgtattaaaaaaaaaaaaaaaaaaaaaaaaaaattcctctcctgtttgagctttcccttacctgtaaagaggggagaatatgtatttacttcaaagagttcagggaaatgactctcactagtttgagattctaggtataaaaatacattcttatataattttaacaccaatgtgagagattattattcttgctaaaccaattcagttttatttgctgtctaaaatgtgtgaataagtaattgtccattattttctgaagtgttttggaactcaacacatgattgtgaggaggatttgttgctaaacatctttctggttattcaagctcgtgtatactgtgctctgttgagacatgcagagttactttctgtctgggtcacaggtcagttcttgatagttttcggacaattaaccagttttcatttgcccatgaccacctttattctttttcctcaactgcacccatcttttataaggtctttcagtttattgcagagaagatggtggagaaaagccggaattcccacccaccgctgccatccccatgttttatcattggctagagtggaaaatagcagtaactactgtgagagatcatttgtttatataatggaaacaaagatgaggaaagaacctggcttagatcagagaactgatgtatttagattctttttttttttttttttaagacggagtgttgctctgttgcccagactggagtacagtggctcaatctcggctcactgcaacctccatttccctggttcaagcaattatcctgcctcagcctcccaagtatttgggattacaggcgtgttccaccacacctggctaattttttgtatttttagtagagacggggtttcgccatgttggccaggctggtctcgaaatcctgacctcagatgatccacccgccttggcctcccaaagtgctgggattacaggcgcgagccaccgcgcctggcccaatgtatttggattcttaaagaacactttcaaattaaatatcagttgaagagaactagaactaaagaatttctgtgtcaaactgtttagcaaatgtaagtagaagctgggagatgtgtcctggaatgaatgaatacatcagtaaaataccatacgtatgttatgatgttattgtttccttgccttggttgatttggttttactgtgaaataattttcaatatagaattgtgatcgttggaatttggtcatctactagaaaatgagaaagaagttaatagctatcttccttaaagatttctgaggttgggattaaggtagtgttcccaaggtgttctaaaacggcagcgagagctgtgcactcacttcacaaatttgaattcctgctctgtgttaggcgctgtgctagg

SEQ ID NO: 182 - DNA, 4550 bp, Mus musculus
  misc_feature (2259)..(2488): exon 1
  misc_feature (3029)..(3029): n = a, c, g, or t.
  misc_feature (4478)..(4478): n = a, c, g, or t.
tacagctatctgtgtgtatgggtgcatgccatggaccacctgtagaggtcacaggacaatctccaattcactttctccttccaccacatgggctctgtaatcactaaggtttgtcaatcctgagtacagatgttcagaaccatcttactgtctcctctcttctgataaaacatgaggtggccccagagacgttttagacagggttataatctgataagggaaaagccacatgtcctttccttacaaatgtaatttctacagacattcctagaaaattgaaactttatggttgggaaaggagagggggccctcaggtaccttgtttttctgttgacaaaagttgactcttaacattgtcaagtaaatgctcccacaaatggatcatctgactatttgcagaatgtcataggccaacagagagagaacccctgaatttccagagaccttcaggttggctcagtcccttcttttttgatgtgtacctcaattcctgtcttcctgaactcttgtttgccaatctgaatctacagtctatctgtcaaacaattcctttgtctggactggtctgctgaactgacagtgaattgtcttgacagttcctttgcctgcccttttacctctgcatcttcattaaactggacagtttgtcatatctgtgacccaccaacagctgcttttcccctaaagctgggtttgtggttcatgttatcgtgacagacactcttatagccctgtcagttctccagcactggcttcccaaggcttttaaaactcctttcttctttctaactctttgtagtcactgtaacctatatatgcatatgtaaacagagatatacttacagagtgatgtatgtgtgatctgagagttaatattagtaattaagactgcaataaaagaacctgtgtttcccttagcaagggctacagagtaaagtgggcctctctggtgccagcgaagccactgtacttagtgaaatttattgtcattcaatacattctgatatcgtgtaaactcctaagcacgtccatctgacatagtgtgctaatgacaggagtcacctgtatgccttatgaagcgcatctcagaggtgatgggaaagaaacatggggcaaaagatgaagggaaatccaaggcaaggaagcagagacacaggcgtcagtggtgtggaaagggagaaaactaggggcagaataagtgaccttagggtcacttagagaaaccaacacacacacacacacccacatatttaaaacgtactttatacagatctgagcgtgcgcactgacctgtttccttctataccttcttgtatagaattatctggtctccactagttagggcagtgaaaggacctgggcccctggataagtttttgctgttacttaactattctagttttctggagggaagagaacttatggatcctacatgtatagggaaatactttcctacacattgaaaagaagaaatgtaggatattaggaaaacgcacagtagaaacaagttaaagagcaagaggttattaaagggcaaaagttaaggctttgaaagatttaatacaaggaggtgacagtcccgtgaaaggtgaaccaagggtacaggagacggacccagcctcattctgcaacagccaagaggagggaaggtgtgcttcctatgcacgtgggggcacgggtggccctccggcacgcgaagacgctgcagttgtccataacctgcggcatcgagctcctcctgtgctccacgacttagtcggctcacgcgtgtcttgcaggaagcatcctcgtgtctccacgcagctctcgcacgccagcacaggccaaaacccaccacctcacttcttcccgggctcatccccagccagcattcgcagtcgagcatgcgtcgtgacgaggccaagggaccgagccaatcagaacacgtattacgcccataagtcggccaatcaggaggcgccttattacccgggagccttgcttcaccccgcctccccgctgacaagcacgggtcgcgcggagcaaagcgagcaccccgaggcgagtgcgcccggcaagccgaggcgtgccctttccaaggcggcgagcagaggccgtcactgtccccgccgggtcccgggcccccgcggcccatgctgggggcggagccagggcggagggcggcggcgcggccggccccgcgcagtgattggcgggcggccggcggtggctgaggtcctggtggccgcgcgggcaacgcaggcggagtcgcggctggcgagccgagaggatgctgctgtccctggtgctccacacgtactctatgcgctacctgctccccagcgtcctgttgctgggctcggcgcccacctacctgctggcctggacgctgtggcgggtgctctccgcgctgatgcccgcccgcctgtaccagcgcgtggacgaccggctttactgcgtctaccagaacatggtgctcttcttcttcgagaactacaccggggtccaggtgaggcgcggccgcgcagggctgcgtgcgagccctccccgcggccggggcggcgcttgcaacccgggcgaacactcgcagcccggcgagcacgtgccgcagctcacggcctcccgccgcggggggaagtttctggttctcacttcggggttccttctggaacgtcctgctgaggctgagtgtgttcccgggtccgccccacccccgccccgggccggctgttactgcccatctcagtgcctgccaaagtagggcactgagtccgaggtggtgatgctgggactggcttcatttgcacttccgaggtcttttagattagcaagacctctaggcgctgaccaaagtgacagctgtgaaggacgactcctgccttgggttcctcccgggtgaaagcgagggcctagggaggaaatgaatacattggttacaataggagcctcactgtcgatacagttctcttcagcttggactgggcttcaatgtgggctgatctcttgtcagattgctttcttcctgctactgtttctttctttctttccanccctccctccccccccccccccgccccgtggagattgaactctgaaaacaataaagagtagaaagctctcctaatgtgaattcgttatatgacatcccataaaaacctacagttgtacttcctttttggttttcagtttcaaagaagagctctgtttgggttctcccagatgtatctatgactttcccccccatttctcagttcttttcattctgtgttaggggggtactttggcgactggatcccttactgagttttgcgccagttggagattatgtctgaggtagggaattaagacctctctgaatcactatctttttaaatgttttcctagggaataggaaaatcactgttgcacatcaaggtttctgaaaaattgacttttagaataggatttcattcagaatttttaggaacccccacactgatggtttcaaacctccctcttactttactaagtttgtcaagtgaatgtatggtctaatcgtggataagtatttaatttcactagcagaagggacaagacagcggggagcacaacttaaagttgctgaccttgcacatgacaagtacccctcagacgctcagggacctctactcaagtgccacctatattcttgctgcagagacgttaggatgagtcagaatgaagcaaagttagtgagtttattgattgggagagaggacacgcacttgaggggagtcaagtgcaaaccttattaccccccacccaggctacagcagctgttttctaagtgattttagggcttttaagttaacgccttaaaactaagattaaggagaagagaaggaaaaaaatgagttcttctattctttccaataatgagctctaaaaaaaaaagaagcaaaccaggatctcacactgtagtcttggtgggcaggaactctatgtagacctcacaggcctcaagttcacagagatctgcctgcctctgtctccagagtgttaggactaaaggcatgtaccgccatgtctggattaaactcttttagttatatgaaatttaaaacggattcatggcggtactgaacagtttacatatgagggagaaatgtggttaggcagtaatatggatcaaaataaaatcaaagtaattagctgatcactggtcacaagagtttgagatgtgagcttgtcttctgccttaggtcaccagctatagggataatcttttgtttgttttttgtggtttttgtttgtttgtttttttgtttttttgagacagggtttctctgtgtagtcctggctgtcctggaactcactctgtaggccaggctggcctcgaactcagaactccacctgcctctgcctcccaagtgctgggatgaaaggcgtgcgccaccacttgcctataatcttacttgtaatggttttagaatatgtgcacagtggagagcagtgttcaagcagctgtatccaaccaattncacttaaagagggagagggtgagggtgagggcctccttttgctattcaaaagcagattgtgtggacattgca

SEQ ID NO: 183 - DNA, 37950 bp, Mus musculus
  misc_feature (616)..(616): n = a, c, g, or t.
  misc_feature (1552)..(1552): n = a, c, g, or t.
  misc_feature (2809)..(2809): n = a, c, g, or t.
  misc_feature (2821)..(2824): n = a, c, g, or t.
  misc_feature (2826)..(2826): n = a, c, g, or t.
  misc_feature (2828)..(2829): n = a, c, g, or t.
  misc_feature (2831)..(2833): n = a, c, g, or t.
  misc_feature (2835)..(2835): n = a, c, g, or t.
  misc_feature (5259)..(5328): exon 2
  misc_feature (6247)..(6247): n = a, c, g, or t.
  misc_feature (8667)..(8667): n = a, c, g, or t.
  misc_feature (8669)..(8669): n = a, c, g, or t.
  misc_feature (8671)..(8679): n = a, c, g, or t.
  misc_feature (8681)..(8685): n = a, c, g, or t.
  misc_feature (8687)..(8687): n = a, c, g, or t.
  misc_feature (8689)..(8693): n = a, c, g, or t.
  misc_feature (8698)..(8698): n = a, c, g, or t.
  misc_feature (9062)..(9062): n = a, c, g, or t.
  misc_feature (12298)..(12298): n = a, c, g, or t.
  misc_feature (12675)..(12791): exon 3
  misc_feature (14621)..(14710): exon 4
  misc_feature (17578)..(17578): n = a, c, g, or t.
  misc_feature (17639)..(17639): n = a, c, g, or t.
  misc_feature (17707)..(17707): n = a, c, g, or t.
  misc_feature (17867)..(17867): n = a, c, g, or t.
  misc_feature (19822)..(19912): exon 5
  misc_feature (21789)..(21950): exon 6
  misc_feature (23387)..(23510): exon 7
  misc_feature (25520)..(26016): exon 8
  misc_feature (37931)..(37931): n = a, c, g, or t.
tggagtgagaggcctgggtataattcctttttctttgtcacactgtagcagttctgcttctcagcctcagttgagactggaatacatttgtcatgctgttctgaagactttaatggttgatctttactgtcaccttgactggatttagaatcgccttggagatgtgcttatggtatgtctgggaggatgtttccagaaagtgtttactgaaggtgtcctcatctgatagggtggggccctggactcaataaaaaccggcatttatctgtttcctgtccagggacacagtgtggccagctacttcacactcttgctgccttcctacatcgaaagactgtatcttttcttaaaaggcgaggcaaaataaatccccacccccaggattttttttggctgtcctggaactcaggtccacctgcatctgcctcctgagtgctgggtctacaggagtacccaccaggcctggctaaaagaaacccttcttaaattgctcctgtcagacactttgacacaacaataagaaaaataattcatacaaagaccaagtgagataatatgttatttttttagttcatagagtagtaggtaatccatggtgagggaaaaaaaaaaaaanaacccttttgaaataaggacagtattgagaaacatgtatgctgattgtatgagttttgtgatatgtaagtttctactcaattcacatggtaattgtgcattctgatcattaatcaaataattgtgtttactactttaaccttcttacaaagtatagttttactaattagtaatttagtaaatttattatttatttaatgaaacatttcaaattggactcagaaaaagaccacagtttttgtacatattatagtagaagtcccttagtaggtggaaatcctgtgtttctttacaaggatatgtctagaacacgttaaacaaacaggaggaggtgtggctgcacccgttaggctaaccagtcaacatgccttttaaagccatacgtgttgtgtgtgagcatttttttaaatatatagaaaatccccaaaatagctagtataataagcacacatgccagtaagcctcttattactgtaaaatactgtgtaatactttgtgcgttcttttatgtgactgcagtaggtctgtttacatcagcatttacccatacaaggtggctactgtcattcaggccttggaaagttttcagcttctttgaaacttgtggggttacttctccagttgtatgtgctgtccatggttggctagacatggcacatgactggcgcatggacctaaagacagattaaagaattcatttcaaatgatttcaagcacagagtttaaattgtacatgcactcttagtcaatgtccttgtagctgcattttggtgtaattggagggacatggactagttagctgtttcttttacttgatgacagttttgaatgaaaagcatgttagatacaaaataatttaactgttgacccccccccacacacacacacacactctttttccctgtatgccttcactcctcgaattggtttttatcanatagctgttccaggtgtaccaggcatatatgaagtagtttatgtagtttcatttatgccagtgcaatcctgtgaggagcaattagtacattatactttatagttaatgagatagatatagagaaagctgatacatcacatctatttcttgtgtaagatggagggctgggattcaaatgtaagtcttagtccgtgtcttatactttgcagcctgtggtcttagtgatgatcatgttatgaagggcaacctctttttcagactgtgtctgcaagacccgtgaattaaatgaccaaaggcatactaactgtagagaaactgcccattttattgatgctaatatttttacatggtaggaggaaacttggaagaaatgagaagccctactcagggggatttttcaggtgagattatgtagtgactagtgtaaaagaagctactataagggataccaagtatgggaaataagtgctgcacacctcagggtggtcacacagactcagactgacagctcaggtcttcctgctgaagaaggggacgtctttgaaagtgagaaattcatgtcttctttatagaaagttctactccagctctaggccgaagactgggggcagagagcttttcttgtgcctgcgatttcttaactgtttttattcaaaatcattcttatgccaaaagggcatatttggggttgagttctttcagcgatatcatttatatttgagaccaatgagacgtttttctcactatgtattgtatttcaactttcatgctaaacctactggactttactgagataaatcaagaacatacctttaaactttgtagttcttctttgccactgtgaccaaaacacatgactgggagaaatggtttattttgcctcccagtcttggtgattttagtccctcacagcagagaagcctggtagagcagctcactgagtggcaacaggactgtgctcatgtgatcatggaccaggaagtgtagaacaaagccagaactaggggccctagtaacctacttctgccagctaggccccacttcctgaaggttccacctcctccctccccctcccaaaaaagaaaataaaaatagtaccaccaactggacagcaaacaccccaaacataagccagtgaggagggaaggagggaggggggaggaaggagggagagaggggggaaggagaaggagagagagaaggagagagagagggagggagggagagagagagagagagagagagagaacacaccanctctcaagtatnnnncntnnannncntggaacaaattaaaaactatgtaaccagaaaattattttaagagtatttgatttgtctgtatttaattaattaactgaaaaaaaaaggaaaattaattcctttctctaaagactttaaatgaaccatttttttagtgtatgtgtgtgtgtgtctaggtcaaaagacaggtctcaggagttgatatttgaccatgtgaaccctagggatcgaacttttagctcatcagctttggcagcaggaatctttatacactgcatcatctcactggccttagataagttttgaaaaaaagtggaagaatctaaagttacttggataattatataaaatataagtctgaggttgggctcaagacggaaagacatcagtaaggagccaagagaacagccccagagagaatctgagaatcaagggtgtgggcaaacatacagtgatctacactttttatctgtaaatagtttgtaaattcttaaccctttaaaaaaattccctaacccctactctgcagatcagactgccctggaactcattgtagaagcctaaggtggcctcgcattcacacaatccttctgacacagctccccaagtgctaggattacaaggataagctactgtgtctgccttcttagctttttaaattttaaaagcactacaaccttgtaactagttttatacttgtcaataaaataacagtaactgggactggggagatggctcaggctgcttttccagagggacccaggttcgattcccaggagccacacaatggcttacaatcatctgtagctatagttcccagggatctgatgcccttttctgattcctgcaggccccaggcaagcatggggtgtacaaacacacatgcaggcaaaacagatgtctttctgcattgctcttcaccttttatattgaggcaaggtctctcacttgaacccagatctcactgattggctagtgtaactaactggcttgctcaaggaatccctgtctacacttcactaaagctcttgctgtgtagcccaggctagcctcaaattcctaatcctcctgctttagccacttaagtgtccgggatttcaggcatgcaccactacatctggttgaaaggtatctttggatggtttgggtattattagcttggaggctagcgatgtctccaaagaaccttacataatttacatatgcatacatacatacatacataaacatacatacatacacacatgcatacatttaactggatctgtagttcttgtaaagtgtacccagtggtccttaaatagttctactttatttctaagagtgatcatgatcatgagctggcatcccaatattaactctgcacagatcaactaaccattggttacttatttgtttgatttatgtcgtttgtaaacttgattagaagtaattagacacgtgtgaacacactgtgcagttgtcttagagcagtagcagcagccttagtgtgagtccttgacatctaactttatattatgtagctacattgcttttacacagggcttattaatgccctttcaggttttgttatcattatggtatttgtgagtatttcaccaccaggaaggcaaacctttctggcatagtagactccaaagcgttcactaacttatgcataattcttagtgacaaagtataagaacaactgctaagtaaaagtgatccaaaggaagggaacagatgagcaacagcagtcatttgctcccttcaagtccctttctaatcactggatacttaacacttacaaaacagaacagtacagtgaaaacctggcctcgtcccttggtttaaaaacagagtgtagccaggagggtacagtggcacatgatgtagtgaccctgacttgatgttccagctcacagggacctctggcctccctgttgtactcccctggctccttagcctgcatttttgttcagcacacaagtggactaacacaagactccagcacacagctttcatttggtcttatgctcagaaaccctttcctctcatttgctaaaatatatccaacggacacagtagctctccattttacaaatccttaaaatatagagtatgttcataatatttgcgttatttcccattatgttattatgtatatgtccatctcttccgctggactgtagagccttatatattattagtgatcaataacttcttgtggatttttcttacagggatatcaatcattctgtcttactttatgatcattaacctgtcctacatttaagtactttataagtatgagctatttatagtgtgtggggctcccaagagaactctgatgtttgttagtcatggatagagctagttacattgtgtccttgtctgtttcctttcacattctttttttttttttaattgtcaaagtcatgattctttttgttttctcttttagatattgctatatggagatttgccaaaaaataaagaaaatgtaatatatctagcgaatcatcaaagcacaggtttgtatttcatttgatgaaatttgggtttttctagaaatggtaaatgagcattaatatgtacacacacatacacacaaacacacatatgtacacacacatatgttttaaagacaggatttcatgtgacccagaatggcctcatactctctgagtagctgagaatgattttaagcttgtgacacacctgccttcatctccaaggtacaggaattgcaggtgctttctttgtatgcttagcttatgtggtgctgggcatcaaacccaaggcttcatgcaaactaggcaagcactgtcccatctgagctacatccccagcccatcaaaatgatattttaaggttatttatttaatgagttttatcacgtgtgtgtgtatctgtctgtgggtttgagcttgtgagtacacatgcctgtggaggccagaagaagaacaccagatcttccctggagcttgagttgcaggtagcgattagttatcctggatggatttggggaactaaactggggtgctttgaaagagaaatatgtactcttaactgctgggctttgtctccagcctttaaaatattaatcttatatatttaagtaaactaagctagcttttgtttttaacataaatttgctgtggattttgaatctggcttgcaattttattttacttttttggtggggagggtaaggttagtaatgtgaaaggtatggtttttgtccaggcttctcttcttccctatttctcaaaataaccctttagtttatttggttttctgtctctacgttatattttctagaatatatatatatatatacacacacacacacacacacatatatatacatatatatatacacacacacatatatagtgggattggtggacccaagtgtatacattttaattcttaattctacatctagcnttttatttactctgagacatattcttgctctgttgcccaggctggactcaaactcaaaattctcctgcctccgtctctggagtgatggatcacagttgtatgctgccactgtttgcactctaactgtgtagttgttaagctgcttattggtatgctggtgtctgactgctcatttcctggacacagtgctgttataattagctgtagttcctgttgctctttaatcctggtagcttaattctaacttgctatttttccgtcagagaaggcacaagactagtttccagtatagaactgtatttacttccaatcaggtcaaatatatatatatttgtttgtttgtttgtttgttttgttttgttttgtttgtttgtttttgagacagggtttctctgtatagccctggctgtcctggaactcactctgtagaccagactgacctcgaactcagaaatccacctgcctctgcctcctgagtgctgggattaaaggcgtgcgccaccatgcccggcgggtcaaatatttaaaactacctctttttgaatgattattgatgaattgtgaattatgctgctagtcctgcggtcccttcatgagggtcctccccatgaggcacctcacaggtacagggcccagccaagaggccaaatgattgcctaaagtgtgctttcattctccaaataattcacctcatccaaaatcccacttcctatattttctaaaccacggccacgttgtgtgcatccgttctatggttcgtttgattgctttgacaagctcaggacctagcatcccaaagctaacagaacccaaccgttaggatattctgaatggaaggtcacttgtgctgatggcttttattttcctcccacccccatttggttgggattgtagctcttgataccgcacccccaacacacacacagacacccggaccatagctaacacagaggtaaaggagctgaaacacgtttttctctgtgtgacacactggaaaactgatgaagctccaaagcttgatagggattttgatatcagatgtattatcctgggtcatgttcgtgagactggctcagactctgcatttgactttgagtcgaaccacagagtggcccagagtgactctctgcttctagccagcctgtctgacacactggctggccctcctcaccacaatctgacctcatgctggtgaggggaatttttacctggctggcccccaggacagggcatgggccatggcagcatcctgtcgcagttctgttgttcagaggtggatcccactgcaggaaactagagtttcccatcaatgtctttcttctcagttttatggaaataacctttccttaatggaactgtaatcctacaaggacaggtgggaccatgtactcttgctctcctgtgggtctcacagtaacagggcggctgaaggcatggctgtggttgcctttgccttcctttagagcaggcttccaggaaagcactgtgagtaagcagcaggtaacagttcctacttggtgtttgagatctgaagataacgtggcaagcaagaggctaagccagttcctttcttagtttagagagacatttcttgactctgcctccaggtgacctcctctaggtctgataacaaccagcctttggggtttgagaacattcttgttttttgtttttggcaacttgaaaaaagtacccagagcctttgcatgttaagcaagaactcttctgcctagacaagcaactgtgcaacacacacagacacaagcaagcagctcaacctaagcatgctgcattccaaatgcctttaagaagcccacaagttgggaacataccagaggaatgactgaactgcgttagaattgcatgttagtctacgtgatggaagaaggcatggagtcttctctaataaaactgctcatggaagactttgcatgaattccaggcttccagagggttcaaaccagcaacccaaggtggatttggttcctggggatgacatatttaggtaaagagagcttaagaatcagtctctgaaagtgtaatttacagaaagtgttctgggactgctgttggttcagcctgttcactctcactctgttcactctggcctgatgctcatgaagagttgacctttaccttagtctcagttgctgcttttacttggtatcctgctgtgtctacatccttgctgcttctaacttgtctgctttcaacactgttcgcctttaaaattcattccttttcatttcctgtctgatagagtatatggttcagtagatggctgtaaagctgagggctctgcattctgggagaccctgctcatgtgtgctgcttctgtgtgttctctgccagtgggcagagcacccaggctctctgagcctgctggttgggtctgaatgatatctattgatagaagcttnangnnnnnnnnnannnnntncnnnnnaaaanccagtgcagtgcctggcatatgggtgacatttagcagtactgtgaatgatggtggggatagcccagtgctggattcatgggcataaacccttatgtgtcatcccataacactaagaattggtgagacacgactgtacagacgaggaaagtaaggtttatttgcctgttctcctctcttcaagttactgaaaacatggcttatggctagataagcctcatggctagatcactgctaaagagtcctgacaaccaaattaaattattcttgccaaaacacaaaatacagatatccatgtgaatgtaatacattcccttacatattttaatccagcgttatctcggaagcagtgtgcataagtagagnacagtattgaatctatattgtattctttgactgtacttatttttttttatttgggataaggtcttaccatataaccccagctggccttgaacttaccatatagaccagtctggccttgaactcacagagatttgcctgcctcagcctcctccaactctgagattaaaggccaaacttgccaccattcctggcttgtaagttacttcttaagtgttgttactaaaatttttaaatttaaggttatggtgtaggatagtttatcttggatgcatgacatatttaaaaatatttatatattctcttaatagtttttagaaggtataccggactccaaaatataactgcttatttaaatataaaaacagatttattgttccataagcttaaaaattaaagtctcaggaaaagataccaaacttggcttttacctatttatctcatttatacccagaatattcactggccagcaaactctgtagagcagtgattctcaacctgtgggtcacaacctatcctgcttatcagatagttacattatgaattgtaacagcagcaaaatcacagttacgcaatatcaacaaaataattttatggttgagggtcaccataacgtgaggaactgcattaaagggtcacagatttaggcaggttgagagctatagccacatagagcctttacagggttcattctcgttgtttctatagaaaacgtttatattagataactttctcacagacttggttatatttccaagagatagctgttttataatccctactctaaaacaattaagatttttctagaaagttgattattcacgtgtaaagagataaaattctaggatatttcatttgtatatgcattatgaaaaaaatttaaatggtcaagaattatgcgatagctgtggaaaagtgccccattttaacacactttgaactccaggctttatactgcagtttgtttgttgttcctcccccgccccatccccaactttctttcatgctaggacagaacccagggccatgcacgtgattagaatatactccttcactgagctgcacccccccccccccccagttcttttattttattttttattttgcgacattgtctcactaagttacctgggtaggccttgaactcatgatccttctgcttcagtctccgaagtagctgggattagaggcctgtgctgtcagcctggatgtaagagtttgttgttgatttaaattagatattgtctcctctaattaactccatttgttgtcattttcatggccctgagtacacttcaacagcatccctgttcatatccttgaattcttctctaaatcctagcagacctttcctgatctttcattttctgttcacatggaaggtacctgcagccatttattctcaagtcttcaaatattctgcttctcaggacactttcttatttctttgtatttcaccatagaagttttgcatgacctcaggcatataagaacaatataatcaaacactgactgataataaagagtggagagatttttatatttttttgtttttttgtttttgtttgtttgtttggttgtttggttggttggttggttggtttttcgaaacagggtttctctgtgtagccctggctatcctggaactcactctgtagaccatgctggtctcgagtgagatttatttttaaatacatagaattttagcagttattaaagataaaaggcagtctacatactgtgagatggataggtttgtatagaagaacttgactttggctgaatatttgatactataggatgtagagcatttccttgtttttcagaattcatcaggattttgattttgtagatgccagtgctaagaatgttgtttccacaaacacattgtacaatatggcagaattgtgtttagtgtcatttcagaaattgtttgaaactccattctaattctaggtcaaaattcatttcatggaactcaagccagtttttataaatcaagcattctaatgtaatacaatcaaaagtgcactagttttgtacttacatgctaaggaatggcactgatgaaatattcacctactttctgtaacagcagaaagctctatgtatacgaaatgtacttcacttaatggcacggtattacatatatgctagcatgtgcagtgagaagcacgcatgttgcatactcaaaacagaagacgcaggggcagctgcacaaggcagcggtgggcagagacacttattcattcatatgtatgtggttttgaattaagttttgctcattgcttatttaaaaacttttattcacaatttttttgaccactaaaatcagtttgcaacccacagtttcaaaagctgcaaaataagacctacatatctacctcgcacaattgtaaatcacacgagacccttgtttgggtattgtaagaattgaacactgtatccaggaagtcattagtaaaaacctaatgtggtgccttgctttttaaagatttatttacttatttaatatatatgccctatcatatatatacctgcatgctagaagagggcatcagatgtcagtagagatggttgtgagccacgatgtggttgctgggaattgaacgcaggacctctggaagagcagccagtgctcttaaccactgagccatctctccagctcttaatgtagtgccttttgtcagacattgtgtatatgggatatttagctacagttgtttcacttgccatttttttccttataattttccattcttcatttaaaaagaaatatctcttattttttttacctgtaattaaatattattcaacagttatttagtatttgggtgttgggttacttagtattttgtagcttttaaacatttgttctttcttttcctgagtatgtttgagtccctgcatatatgcctgtgcactgtgcatgtgcctggtgcacttggggctcatggagggcctcatatccgttggaactggagttagaggcagagctggcttatgggtaccagacctgggccctctgcgaaagcagcaactgaatccttaaccactgaacaaaatctcttcagccccatgtattttgtacctttgtgttttatccttgaaataaatggccttttaagaaatgagaaaagcctttaatcccagcagaggtaagtggatcactgagttcaaggccagcttgtccacatagttccaggagagccagggctacacagaggaaaaaaaaaatncaaaaaacaggaaaaacacacacctccttgatttaagggttttttgtttgttggttgttttttttttttgagttttggggagggggtatattttttaatgtgtctgtagttggctttgttttaagcattttaatcatactttatttttaaaaaaactaaaagcttttttaaggctaggtcttgctatgtggccctagtgttcctgggacttgctctgtacaccgggttgactctgagcctgtgcgccttctgcctctgcctccatagttagattctcaggacatgttacaaagactgtgctgtgaagatgagtttttgttcctgggagggaaggttggagctgacttgtgaggtactgacttgggtctgccttacagttgactggattgttgcggacatgctggctgccagacaggatgccctaggacatgtgcgctacgtactgaaagacaagttaaaatggcttccgctgtatgggttctactttgctcaggtaaactttgtctttgcccttttatttcaaacttaacaccatttaatgaaactatatctgatttttttgtttatgtgtttgttttatggtacccgtgattgaacatggggtcatatgtgtgctactgagtgacagccttagttcagacattttttaaagcgacttttactagtatttttatttagaattctatatgtgtgcacatgcatatgtgtgcttgtgtgcacacgtggatgcatgtgaggtcgaaggacaattttcagtacaagtgtgagtgtcactttttaggcaccttccactcttattttgagacagtctcctagacctttgctgagttgcccaggctagccggccagtgagccctgggcatctaccggtctctgcctccttacctttacttaggttacaagtgtgtgctgctacgcccagctgtttactagattctagggatccaaatgtgggtcctcgtaacttgtgagacaagtactttccaaactgagccacctccctagctcttcttcacggttcctgatggtgtgtgtctagatggctggttgtccgtatatttaagtccagtagcagaaatacaaatacctaggagtccaatagaaagctacaagtgcagaattgacaatcggtaatgttcggaaattgattcaaaagtagttagtgagtgacagacaggagctaaaagcagactctgagctcagagtgtgaagtgtggagaaatgtgttttctcacagttctgaaggctgaaagtctccccaaggtcaggatgtgggtggtactgctgtctcccaacacccacctctttggattatagactgcagccttctccctgtgttctgagccggcctttcccacatgtggacatccttggtgggtgttccaccagcagggcctcagctagtgcccttatttcacttaactgtaatgattttcttaaagaccctgtctccatacacagtcactgtggaagctgaagcttcaatgtaagagttaaggggggagggggaaatttagtccataatggtgtcacaccaatctctgtagctgagtccatgattcagttctttaaaggctctgagtgtagacattatcttaattattttgcccatttatgtattatctttaatttattttatgtaactgaatgcctgtgtatatatgtttctggttcctagtccatattttaattccttaaaggatggaggtgtagacttttgtctttttaattttctatccttccctcctggcctcctgtggcctcttttacgtatttattatttttaatttattttatgtgtttgagtgttttgtatctatgcattcctggggcccatggaggtcagaaaaacacattaggtggcctacaactgagttatgggtggtttgtgaccatggggtgctgggacttgatcaccagtctctgagaagactcgtgtctgctgagccttctctccagtcctgggagtgtggatattttaaggatacttttaattgacttggtgaatgacagtagaaaatcaatgagttaggatccatcggaaaaagcttttgaactaaatcttttaaagagaaaatattttaagtgctaacaaaattaaatgtgtattttccatgatgcagttttacttgggctctgtagaaataggattttcaggtacatattgtatatatagttggcaatatttaaatactaactgtcgcttgagttctgaaatgtagttttatgttttttactcattaggagtacagttgccttaataactacggagattagttattaaagaataattgctcttcttttttcttttctgtgtaccagcatggaggaatttatgtaaaacgaagtgccaaatttaatgataaagaaatgagaagcaagctgcagagctatgtgaacgcaggaacaccggtaagtgcgcccgcttttattcctcaaggcaggttaagaagttaagttcttaagtcattttgaaaatatattaccccatgtggagcaatggaactggttcggggttttgttgagataagctgtcctctggccgtgaggtaagattgctgcaggtgattgtaaggtttctcctgagtaacagtcagcatgggctcgggacgggcaagggcaggccttagtgtgcagaggatggagctcactgaagccccaaagagttagtcttcacatgagattcagttctagaagaagttaaattgctttctttctgtgtaaatttggatttttattgtagaaattaaagtttgttttcttttaaaacaaacacaaacccagagcaaagagtctcctagtgaagagtcattccgtgtcagtattttacacaactgtttttctgtaaagggggaaaaagaattcaaatcttctctttcaagaatgctgactgctgccaactgcctctccccgtggcccctctctgtatagacaggcatagctatggtgaggacttgggcggctcttgtctttctcctctctctgcttctctaccctttctctcgtgccctccacttaccaggccctgggaagctacacaccaggcaacagtgaccagggcctcggcctgggcttcgaccaattactagagcagaaacagcagcagctgcagtgttgttttgtgctgtgcactgtattaggttgtgttttcatcacctttgggttttgtgatgttttgatgaagtcctggtaccattctagtttttacattctgggtagatagagtttattcaaggtctcaaggcatatgaatggaagagctcctctttacagccattcgtgtagcatgcataactgctcttctgtattctctctagtgtctttttttttgtgtgtgaatctgatgtcttgttattcacctacaatgtggagtaatggtcataaacatataaagtacttatgcctttatctgccaaattgtatttaacttttcagcttttaatataactttttatataataattaatttattttaaaaaaaattgaataccagcctgttatagtggcatatgcctgtgttcctagcactcaggagacaaaggcagaagtgtgagaacttcagactcatactcagctatatacaagaccccaaatttgtgctagattctgcagtacagccatgagtgtccccatcttagagggagatcgctcatccttgtgctgttctttaagtcttaccctgcaacccactgtaagtacactcttgctcacagtcctttagaatctcacactctttctctttacagacaccatgtcattgcccactttattatttatctgatgtctacaaagattatgaaagagaaacttgtatgcattctgtgtaaagtacttgacacaaataatagtattcaagaatgacttcttaaatgaacactgaatgaatagtttgttctaatttttttgatcaacaaatcaaaaaatatttagattaaatatctaagatacaaagcataataccacatgaatcattaaagtgagtaatcaatcttataagtgactgaccctaaaactcatagacattaataattgctttcattgcttagatataaactttattgattaatacgttctcatgaaagtggttcttggaaggttctggaaacgaaaatatttttcttactgcttttttcttctagtaactgattgaatttttctgcagttccataaagcatctggtcaattgctattatccaatatgaggatatataacaaagtattgatttttaaatttggcggtgataagacaagactgggcgtgtgaatgagggggtctctgtttcttgtcccttctcttgggttcttttccttttgttggtttgccttctccagctgctatgtgatgggttctgattatcttattatatcttattttgttatttttcattgttatctcttagaagccaacatgttatatcacctccactcccaccattaggtgtctcacaaataccccaagctaaacaaccacatcatgtcatgttctgtatacttccataagtgttgttaactctactgactcttgtgagcaggcccaattggctttatccctagctgggtgacctgggttcctccccaacaccataccgtccatcaaactgagtccttttccaagcacacaccagatactgctcatctgaggactcttctcatccacctaaggactgcctgctcctcggcagaaagggcctctagtcccatacccttacgccctcaccaatgccttaggaacatgtgctcaatgcccctgtgggtcatttccgtttacagtagggaaatttgcctgataacttgcagcacacctataaagaggccttgcttgctctcatatttagctggagaagataatgtactcaccaactccactctatgcaacccagtctgctctgcccatgccagtcagacgtgaatcttacacctggattcagattgatgaatctacaacatcacccactccatgcttccttctaaatcagcagttctagcctgaatgacagatgctacccaagtctcatctagttagccctgtccggagtaaccctgaccttgaggattagaccaggatgcacatcctgcaccagttccctttgtccacctgacttcatcccacccgggccatagcccatgctcaggctccaccctccatgcacaaagctggcttttccagcttccttcacctgtatcagacacaaatagcaaaaggggtccacgtgcctaggtcccatcacaagaccatgtgcggtagtttggaaaacagtctccacttgaggctcagatagnttggaatcttggctctcatgtagttgtactgattagatcagtttaggaagtatgacctttntggaaagaacatataactgggaggggctttgagatgtaaaggccccacacaattcctagttcaaactntactgcctgctcaaagcttgaggcatgaactctcactgttcctgatgtcatggttcctgtctgcttccacaattccctatcattaggggtccctttccttcctggaattttaagataaataaacacttcttttaaaacaacaagaacaacaaatctgacnctgataatggattttaaggcgtcttctctggataagaaaaaaaaaagaatatatttgcataggtgctgtattacttttgtcattggtataacctgactggaagcaacttaaaggaagaagaatgtatcttgatttgtagattaagagcaccatgactaagaaggcatagcagcacaggtgcaccagcaagaacataggctgctagctcagatctctgtagatatgggaacagggcaggaagctagtagtctataaacctcaggacccatcccatggagttccttgtcttccagtgatgtcctgtgtcttaaagtttcacagttcccacagcagcacctgccgtctgggaaccaacctgtggtggatattttacaacgtgataggcatattttgtctctagccctgtaggtttatagccatcctatacttcagtttatctagtccacctcagtctgatggtcttatagttccaacacttcaaaactacaaagtcttaagggccatgggctcgggtttattagagcagtaacacctctactagctttctgtgttacccactcctcttaaggtctggttgaaatcctaataggaagcagcttgagaggagggtttattgtggcccatactttgttggtacattctatcatgcaagggtggcactgtgatacagccgaggccatccgaggatggtactgttggcttacatctgggtgggacaggaaatggtaattctcaaggcccacctgcttggtgacttctttcagttaagccccatactctaaatcctctacaacctcccaacataatgccaccagctggggatcagctgttgacagtgctggcccaggggagcagtttaaatccagaccaggggacctgaaaacagagaactgcagaggggctgtgggactttataccagctttgcagacaaatcacggcatttctttgtgagcttggttcataaacaaatatatattctcctataggctcctttagtgggtgtttcatatccacaaatttgttcagaaaaacactgtgttttatgctagctgtgtaggagataataccgctgggagtcacttgagcatggataagtgacatagttcgtcctcatgagtccctgtcctgtttctgtattatgtttacttgatgagtttagtttgtcagttggccaccaattaaaaagtatcattttattttttttacaatactcagttctcaagttaggagttttgttattatatggcttcaatattcacattttaacctttccaggagttaagtataaaaacttatatcaactgttgacttagtaaatatctattacagatactatattcttcttagtttatatcatgaatatgaggttgcttaaagtaagtgatgtaaaatacactaggggatgcttataaaatggaatgttgtgagttttttgaaacacgagtactaaattcataagtttttaaatagttacactgttagcttcagtactgctagatacatgtctataatggctgaagagtggagcttggatattataagtgtactctgtatattcatgcagacatatagcagattccactagtatgtgtggttaatatgtgctaataaaaatttaatacaaaagtcatgttttattactgggaaccagaggggttggttgtgctgattttaagtcagtgactattagcatattctaagaaacagttttaggattttaaagattggctttaccataaatgtagagctatgttttactataatccatattatggtcggccttaattcaatctctgcagtttggttactctgctcaaagtgaaggtcatttataaatgatacacattttctcaccataggaaatactacctggccaataacagagttagaattgctaaattgatggtaccaacaatggactcaacacaaactaaagtttatttatgcccacagatgtatcttgtgattttcccagagggaacaaggtataatgcaacatacacaaaactcctttcagccagtcaggcatttgctgctcagcggggtaagtaaagatttaactgtattcagaaaaacacttttttaagaagagtgatctttgtttccttcagagtcatactaaagaatatgcgtttcttgtaagagctaagtgagagaatatccgatcttctacagagttaggtatattcttattagtctgtgtctgagaggttagagacgcaggcttgctatggcacatttcccatgctgtgaattgagttaaaaatgtaggtaaatgatatccccaagaaagtatacttttggagtgactcagtataaagcctggtgttataacataaacacgcacgtgcggatgtatatgtagcacatatgtaaacacaggtatatgcattgtaataagaaagtggaggtcggggcccactgcaggcaagtcttttagtgatgctgagctaatgctgagaggtagaaagaccaagaaggctggagttgctcattcggcaaaggtcagagctcactgtgtgccataactcgagtgttctgtctcccttttgatacagttttcttgtttttaattattagtttttacaattatcccataaaatgtgggctcattgtggtcatcgttttcataaagtccttcaagtatacacccagcaagtatctaaatacactgggaagaatcagtcagctgatggcttgaagtttcaggacatctagtgccacatcatgcttcagaaccgacctgcacttagtcagggtcatattcatgccacgtgaagacgagaggaggccatgccgtctgacttaggatggaaatttccttcgagcaaacacgaacgggctaggtcttagttataggcatagtgtctgtggttatactaggcagacattagtggactgggtgttagaaggtacagacaggcaagaatttgctgtagatttgtttccctcatgtgttgacaccacatctaacctgctttttgagcttctagtcctaataatctcataaaaatactggttgaaccagaaatggtgttgcaaagctatgatcccagctcctgggatctagggtgggaggatcataaatttgaggccagcttgggtctgtcttagagaaaaaagaaaaataaaaagtctggtcaaggtaacatggagcctggaagtttcacagggtgattctgtaaaggtcctgagacaagatggcctctagtggcgaatgacttagctgacaagaaaactttcccagcttggttgacttttcagacttcatacaagtttgtgaataaattacactccttctgcccttgggactgaactcagatatgtggttgtgggaatggctttctttcccacaccaccctgcattttaaaaattcttctgtagacagtcccaccatcctgtagctgttcttccttatgtcgccactttccctggagagaggcagtgcagacttcaacccgcttctccctagtcgctgttcatagcacatcgaaagacctagtgcttcctgtgaaattgtaagtacatcctggagtccaggagaggaggaagccgaacagagtggagggaatgctgagttctgtcctaagaaagactgcgtgcttagcaagatgctgctgctctcctgtcgtgtctttcttgtcagaacttatcaaagagaaggctcgcagtgggtcataatcttcccaaggaccagccttcccagcttctcgcagcatatctcattcatgtagatgtttaatggatatgtgtcaatggggttgacctaagtgagatggcaatgtatgtgagcattctaggtgtgaggttatggcattaaactttaatttccgtctatttgtggtagttgataagtaatttagatgttgactttcatgtattcctaattatgaccacattgaatctacctgctttctaggccttgcagtattaaaacacgtactgacaccaagaataaaggccactcacgttgcttttgattctatgaagagtcatttagatgcaatttatgatgtcacagtggtttatgaagggaatgagaaaggttcaggaaaatactcaaatccaccatccatgactggtaagtccgtatttccatagaagctgaatagtacatggtacaggtaagataaactcttgtttgttcgctttgcttagcttggttcagtttggttttcagtagagggttccactatgaagctctggctggccgggaactcactatgtagaccaagctggccttgggctccactacacccagcaccaatcacccactcttatcttttatgctttttgtttttgctttgagctttctttataacatgtttgggaaggacattgtcattatttacaagaagaaatatggtcttttcccaacatgctagaatttaaagactcagaactcttgcctttgtcagtgacaaagtgagaatggctgtgaagtgacgtggctttgagtgagaatagttcaggtaactatagccacagactcaacatttgaacatgggaacaggtgagaacggagtgatggaagattctggcccctttcagagaattcattttagagagagatgagagtagtaaggaagagagaagagagagacgtggtattttgctgcagactaaagagatctcttataatcgcagtactaaggaggaagaagcagaagatgatgactacagggccaggctgaacaatctagtaaaatcctaagtcaggaagtcagggctgaggtgcagctcagtaggagagttgttgtctgccctacacaaggcctggatttagctcccagtagcaacgaagggaggcgagggtgggcaaaatcgaacacttactcttggagactccctttatgaatattaccacactccagtaaatactctccagagatttcagatgagattctgcttcctggtaaacaggaggccaagaatattatgtcacactgaacatgggatggaagacatgttctgaggaatgtctgcactccagtgtgatgaagacttgaagtttagggacattttccctccctggccccactcaccccatctgtattgagtattcccctagtgctcatctttatttgtatgttaactttcaggaaggggaagcagattgatattcaaacccagccagttttcttaaatactttgtggatgggattggctttgacagtaaatgaggaaatgtaaaatgtaaaagattctaatttttaatattttaaaggtgaggttttctgttagtacgcagagtgagaggtttcttactgatgtctgcgtacctagaggaaggatggctacttctccaaggcttgctgttagaagtcagtgacatgggcttaacaagagatatgtgctaatgaggttttaatttcagcttaatactgcaaatcataagtgcatagctttattgttttaaattcttttagtcttaatgtttcatttttaccataagttactttgtataatcacaaattctaaactagtaagacgtgaaattttcttcttctttgttagagtttctctgcaaacagtgcccaaaacttcatattcactttgatcgtatagacagaaatgaagttccagaggaacaagaacacatgaaaaagtggcttcatgagcgctttgagataaaagataggtaagtggtaagagctccagcatttagaaagtgcagttcaaccaaattttactctcagatcctgcttgaaaggagtctttttatcttcattatttagtaaatactaatcatacctgcatagacaagaccacatatacttaaatgtagcatgtttcatggtgcgttacccttgtttaacaattaagtttaacatcctacatcagtttgcctgttgatttctgtaccatgacaactcaacacagcgatgcgtttattccaaagtcgatagcacagcaaaagtgaaactaaagtctgtattgtttcaagaatgctttttgtgaactcgggttaaatcttattctatcctttcgtgttcacattgtacattttcatgagtcactataaaaatcatgacatggtggcctacctgcagtgtttgctggacagtaggctgctgtgtgataagagcctttcctcttcagctacacgggggacacgaggctttggggttcaagactgaagcacgggtgagcacaacacctttgtgttgtgggaaggaagggaattgttcttttcataatgaaattgtcccctttcttgagttagtagaaagtattacaaggatagagagttgaaatgaagctttatattagatttatgccttgtgttgtcacgtgtttctacctgacataacttttcaacccagccgctcaggattattttgatgatgggaacaatgtaagaaggcctatgtatcggtaactcactgttgtagctctgtggaagcggctcacaggcagtagggacgcttctgtgcttttgtgcctgtcctgctgttagaatcttacagaggaggatgaatgaatgaccctttttatttctcttgtctgcttttctaattttatgggaataagaacttttggtaggtctctgtcactggcctcttgttgtgaagagacaccttgagcaaagcaactcttctgagagaaagcatttagttggggaattccttacagcttcagaggttgagttcgttttcatcatgctgaggacagggaggcactcaggcaggagaagtagttgagagccacattctgatctacaggcagagagagacagactgagcctggcatgggttcttggaacctcaaagcctctcatccctaccccatctcccgacccctatacacacttcctccaacaaggctacaccttctaatccttcttaaagagtcaccacatccagcgactaagcattcagatatgtgaacctgtcggagcctttcttactcagatcacctcaggaggaaaactcctatgctataagaatttcttttctttcgcatctttgaaagcttgtttttgtgtgattagatcctggcctcacacatgctcggcaatcattttactgttgagctccagcctcagccgttttcattggcttatgggatgcgagccatgggagagaagctagaaggcctttcgttttatgagtcgggttggtggaaccacttacagatggaagatttacaaacaaaaatgaagctggggccatcaaggctcagcactcgctgctcttccagagagttcaggttcatttctcagtaaccacatggtggctttgtaaatgtaacttcatattcaatgaccctgacaccctcttctggcctctgtgggcaccagacacaatcatggtatacagacacacacactagccaacacccatctacataaaagtatataaacatatctttatcttaaaaatccccgaagtcctcattaaatatcttagatccccgccgtgttttgatttttgtttcccacgtggtgaggatataatatcatgtccaaactgtaaggagtgaatgccctcccgtgcctctcggacacctctgcactcatccaagttttctaaggagctgtacttgctcagcaagtactcaatacctaataaatggtttatgtttgtttcaacaccaaaaatgtccaaaactgaaagatcaattctgttgttttccttctggccataggttgctcatagagttctatgattcaccagatccagaaagaagaaacaaatttcctgggaaaagtgttcattccagactaagtgtgaagaagactttaccttcagtgttgatcttggggagtttgactgcggtcatgctgatgacggagtccggaaggaaactgtacatgggcacctggttgtatggaaccctccttggctgcctgtggtttgttattaaagcataagcaagtagcaggctgcagtcacagtctcttattgatggctacacattgtatcacattgtttcctgaattaaataaggagttttcttgttgttgttttttttgttttgttttgttctgttttaagccttgatgattgaacactggataaagtagagtttgtgaccacagccaacatgcatttgatttggggcaaacacatgtggcttttcaggtgctggggttgctggagacatggaagctaagtggagtttatgctgttttttttttttttttaatgttttcatgaattaatgtccacttgtaaagattattggatactttctgtaattcagaaggttgtattttaacactagtttgcagtatgtttcgctatattggttatcttccatttgactacttggcagctcagactcttaatactaaagtattttacattttgaagctatgtgatactggttttttgttgttgttgttgttgttaatttctgaaagtcaatgaaagacactgtaatgatgcgttaagatgttccaagaaaaaggtgagaattattcatggcaaaaaagatctgtctagtgtatatttttattatattgctctatttagctaattttctttatatttgcaaaataatgaacatttttaatatttattaaaatgcttgatttgcatacccccgattctacagagaataatgtgtaaagtgtcagaatagacttgaagctctgctgtgactcagtctcctttgtcagagcttctagtagcccagctactgagctgctttgttagtacctccagcacctgagccgttaagtacttataaatgcaagggacccgttatcttcatatcggaatagacatgaacagagctctaaggcgatgaaagtctgccagcatcctctctgtcctcgcacgtgccttctgcctggctccatttgctttggcactgcgttcgatctagagtgtaggtgctcactgcttatttcagccctggctctgtggttttgtgtcctccagtggtgctgttcactgttggggtgcaggtggtgctgccctgactcagaggggcagctccctggctcctgagggtgagccttcttggctactacagaagtattgtgcgtttgtgtatggcaagaaccatcaggattggataaatgtgttatttctctttgatttccatggagccacactgttggtacatgtcccctgtgaacagagctacctttcaggagcacatcatactgtcgtgagtcacggcacggtgtgtcctgtgagaagaggctttctaacgtgtgatttgccgtgtttctatgttgtgatttaagcgtgattgcctactagtcattcaaggtaacatttctgcaaatttcatacagatttttgtcacaaaattactataccaatgatctagttgaaatagaccaattgaatcacaataaataattttttttaattgagggaaaatttgcttcttgttttttcaaagccagaaaacgagccatttcaaacatctttgaagagtcatgtgctgtcacttgttttctatgtgttagtgtctatattcatgtatggatacacatgaacatgtatattcatacacacacgccaatagaatataacagcctaaaaacaatccagcttgtgtatcatgttactgtgctgaattgtaatggtttttacttacaaagtgaggctaaaatcgatttcatgtctttgttaaatacgtttttttcagcaatcctattagagcttattttgaccagatcaaaataagtacaagttcagagactttaaatatggctgaggtctagagcgatagctcagtagttaggaacacatgccactctttcaagggcttcagttcccagcactcatatggaggctcacagaaggctggaattccagcttcatggaattggacacatcctctagcttccatggatctgtctgtctgtctctcccttctctctctctctctctctctctctctctctctctctctttctcaccctttaaatatcatggatatgctgtgcatttaaattttaagacacagaaccattggaattacatggattatagctgattctctttgaacagggcacagtgttctgcgtaagatctcttgatcattagcactggactcactctcctcacaagtagcctatcaaatgtggtattagaaaatacattgtgtcaaaatctttgaaagatgagaagaatctcctaaacatgtttattttgacttgacatcactatttcctgaaaattaactgtctatgattcttttcacatagtgtaagatcttacttgtatcaccatcagcttgcagcttaggggctgcagttgttctccttcataagactgccatccgtgtgcatgcttttatgtttttcagaaaggatgttgggatgaaagtaagaaaacaaagtctcttcttgtctctcatgtctgtgatcactagcatttcacaactcagggattcatccattttccagcagataaaagggttagcgattaaccctgcattctgagtttagaaagctacaatattttttaaatattgagcaatgattttaaaaaaatacattggaataccccaaattgtgaagcaatccaaaagttggactgtataagctaatttgcctactttaaaggatgtgaccctcacccaggaaacctgtaggatttacttaacaaggctttacatgaaaatgccaccgtggccatttcttaaacactggtggcttcttccagatttcatttctatgtttgtttgtttgttgttttttttttacttagattgctgtgaggttttttttttataacaaatatacatttttttctttgtcacattacatgctttgtcaatcaaatgacctaactaggttggctattaagaaaactacatattgaaatctgccaaaatgtcggcataaacaaactggctcctaattgtgtaccagatctacatttgaaagaacagaaatgtctcacaagacaataaggtcatatgtaaaacactaaataaactttaacctcaacaattgtttctgaagtgttgagattaaagactgagtgtttgcggaacgttgacatgtccatggccaggctagtttctcgttttctttttgtcttaagactaaacattggctggcttaaaatattaccagttctatatagtttacattatagacagaatatataacatttaagtattagtatgaaaatcagtactttggtgagactaatatttggaatatccagatgatttgatatcatgtaggtaaagtaagtatttgtgtgactgactgaacttaaaatctcttattcatatatcatggataacagctgggagttgtgacacatggctgccatccaggcactcggaaaatccaggttttgagaaagagagtgttttccaagtcagcctggtctatatagcaagcttcagactagccaggactgtgtaccaagatcttcttcacgccacccacacaaacaagagaagttatatagagaattgcttgggatttagttacaacatttttgttaggatttcatttaatgggcagggggtgggggagttagcagtttgcattttcagagaatgggttccattcccagcatccacagggcagtaactgaagtaactgtagttccagggtatccaacaccttcatatggacacacacgcaggcaaaagaccagcatgcataccattaaaatgaattattaaaatttttttaaaaaagactttgatatatttttagtttgtgtatgctgaggtggatctgttgctcttggcaaactgagtagtaatacgtggagttttataagaggccagagatctcactttcatataatataccttggataataacctagttgctacctaagcaaagaagttccttggaagagctacatcacagaaaattggtatcagagcatatactcagtccatggttatgccatgagacaggccagtgttttacccagactagtgttttgtcatatctgaataaataaataacaaagtcgtattctacaactctaaatcctcatatagaaaataaaataggaatgcggttgacacaatttgttgcctgaagtgatgaggaaattaagttacaaagtaatcaagaagtactcagttactgtgtcttcttatgtagcttcagaataagttctgatagtgttactgggtttcctggtgctttataatccagtacaagggaaaatatgaacctcatttttttttataaaaatttggtgacaaaaaagttacattgttttataaagtgttttgtgttttatgtgtatatgtgtgtttgattgccagatatagctataaagctacattatttcagatgggtattttgtttgagatttgctgggtgttcgctgtatgctgactgcttctgcacctcttgtaggcaccagcctgtctgcaggcagaccacccaccccatgttgggtccttctgcctctggttagccatccaaccttggacagctttaaataaagagtgtcccaggtttatcacctgtagaacattgctaccacctgtagaacattgctacgatgttagccacaaagaattgttgagagcatgtgaactactgcagatgatgcagcagatgcagagcatagaaagaatgtagctggtgctggctcgggttcctgtcctctgtcttcatagatgaccttcaggtcagatggggtttggataaagtctagggatgggatgccatctggtcctttcctgtttctcaaggagacagtggggtgtggaagtggatgctcgtagttatggttcagattgtaggttttgtttaagattcagatcacgtggtgtagagagatacaacaagagaaagaacatctccattataagtcacatggcctctcaactacagctcaatagaagctggatcttcagggctaggagtgggctcagtcctcacactttgggcacaggtggaggggatggcatggcagctgcagtaatgtctgaggggttccttctggcattccgcactatggtacgttttagactaagttcgagacaatgcctatcggagtgcccctttatccgtgtagtggggagtgtggaagtctgtggagaggtcagtgtggtgactccatggagtgtgggttcccatatgtaaagttgcactcagctgagctctatttgtcgaaagtgtgagggtacatctgttcattattttctgacatatattagagctcagaattgtcaggaatgttcatgattaaacattgttccttgtcatttggaaccatgcctatattggcttctgtcctatgcctgcacgagttaactttctgtctgggccaggagtcgttttgatttttacaggcatctaacatatttctgtttgtctgatacccccttccttctgttttcctatctgcactgtctcttcagtctgtcgcagaaagagcagagaaagtccttctgtctcccaagacctcccatggtctttgtgctcttgctgaagacaaccaactagtgtggcaactagtttgatatcttttctctctataatagaaatgagatcatccaagttacgctggagaactggggtgtgtgtctgtgtctctgtattcccgctacccctttctcctagagaaattcattgtagtttggttagttggaagtcctggtaaggtggcaggtcctgtggtatagtgagggccttattgctgggctgtgggactccaaagtgagtctcaagtcccccgaggactcaacctagtacccaatctttccaaccaccctttctttccaaccctatgacattaaattttcagtgcttcaattttggagagacattcagaccatggtaaactcacatgagcaccaagttggattcttaggggaattctgaaggaactgcttttaaaaataaacagttttcctgatgaggttgcattggaaccagctgtttagaactgaaccccctcctcccctgtgaatggcttgaacaggtggtttattttccagaagcaacatagagctggattaatttgttattagggaactaaattatctgttgactatactgctaacctcaacctcaaaatgtagtagtggctaccagaccaccccaacacctctctgattaaagccatcaagaggacagtagaggacagaagaatgcctatttcccttcaagacatttccagagagtccctaatgtttctacttagctgtgactgcctggaacttagtacaggcttcatttagctgcaagggaagctgacaagtgaaatcttcagctttgacatcctcaataaaattgaaggtctgagggatgaaactattctgagaacagtggcagtgttcacaccatcttctgaatataaatgctgaagattactaaatggatatggtgaattttaccacagtccaaaccaacagagcaggctggggatgtggctgagttggtacagtacacttgcctagcatagaacagctgctgtggtaacaaacattgttacaccaaacactcggtgtgtggatgcaggagaattagacatttcaaggccatcctcagctctgcagtgagttcaaggccacctgggggtaactgatttccaccttactttttgaggcagtgtcactaaacctgtagttcactgatgaagctacagtggcccacaaactccagcagccctcccagggctgtgactacctttaaacaacaacaaaacaaaaagtgctggagatccaaactcaagttcttatcctcagggcaagcactttactgactgggcttccaggcctgctctattgctgtggcaagactcgctataactacctacaattcctcttcaacatctatttggattctctttttctttgtttttgagacaaggtttctctgtgtatctatccctggctgtgctagaactcactatgtaaaccaggctgtcctcgaactcaaagaggtctgcctgcttctgcctcatgagtgctgggattaaaggtgtaccaccacacccctacctattgggttcttaaagggcactttccaaaactgatgaaggagagttaaaataaggagaatttttgtaaaactaacatgtaatgtgaactgtgaatgtatgccccaaaatcctacatatctacaaaatacacgagtttttcgttattttagtcaccttctctggttggcttggttttactcttgagtaatttttactaggcaactttcaggacagaatgacagttcttgaagtttaatcttagtagaaaaacaggcaatagtgagaaagctgtgtcacagtgttgttctgcaaccactccagatctattccctcccaatgtctatggagtgcattgtctgcttaggtgctgaataaggacatgccaacatttcttatctactgtaaggcaaaattggtgagcagtgtcactaagcctgtagttcactgatgaagctagagtgcccactagtgagccactatcactagtgagcacactagtaatagtgtgaaagaaagtgacttccactgtcccatgaacacacccaccttcatctcctctaccttgcacctggttcagatttcggcagatgcagtgagcatggtgcttaagaagtctgaaggatagctctgggggatggtggcacatgaaggtcacatctttttttaattaggtgatttaaatgggtttgtgcacatgagtgcaacacccatacaggccagaagggggcataagatccccggctctagagtgtcaggctgttgtgaactgcctggaataggtgttgggaactgatcttgggtcccctggaagagcattgagtacatgtcatcactatctctccagcctcacactcttatcggtatgtctcatttgtgggggcaatttggggagtcccacctctggatcaggtactgtgaaatatggagttggcggggctggatccctgtcttgccaccagccagctgaggaaagctgtcaattgtcttcctgtgtctgcctcagtttcctagaaactagaaaggaaaaatggatggtatcactaagttcagccttccattgtaaggatccattgaagtagttggtgtgatgtactcacgctggtgcccctccccttctgagctgcaagcatcagctgttggacccagcagttctgtgctccgacaggaagcagtgggaaactgggctgcaagatgatcccagttctagcatttgctgcaaccccctttgctcacatctgtttccacattttatttcatccttgagcacataaccttttcattttgatacatgcttttctttacatagcctgggccagccttgaactcatgctcctcctgccataattccttaaggactgacaatgacagtggacatgcaccgccaggtcccactgctcctagtacttttgttatgggtcttctatgctggtctaatgtggaatgtgacactgcacaccaggcattgtgggatgaagtagaacatgttcatgcacacaaagatcaatcccaaacagcatctgcccacccctcccctctgccccttcccccggtggatgttagcattctcttgtgtagtgctgggtcggccccttctctgtctctaaacattgaaacaaggggaacagacccatacataactccaacacagcgatctggtccaagtctggatgtagaacccttggctctgctcttttctcctcttcccagagctgtcccagtcgcctccctttctaattggctggtgctcatctaacttgatgtatatgtttctttcctggtctgttttatgactggcctgctccagtcattagtgcatctggtgttagaagctaagctcaacttggcctcacagtcttgatgttcaggacacatggggttatggctggatcctgtgtcaagcacatcacttctttctgaacccacacatcttaagacatgggcattgtcacatggctgacagcagtacattcttgtatgtagttttctctcaagtgttttggttacatggccctaaagcctaggactgtctgtcttcaatcatgtctgccacctgctgcccagcaagcccaagttgtggttcttcctgtctaatctgcctcttttatctttagccctcctccataagcctcttttccactgagctctgggttattcagattacagctccctactgctttcctgagaccctaagccgctccacgatgcacagcagcactttccagcagtcctatggagatgcagtgtcgagatgatatgagctgtgctgtatatgtaaaatgcatggtagaatctgaaaaccaagcacaaaaaaataaaaaaaaagttcattaatatttatagcaatcatgtaatgttttgaaaatacgtgcctaataaaattattttcacctttttaaaaatgtgggtactatgatgtttaatagcgcatattcatgtggcatatttacctcaatggggcatggaaaacaagacgacaaagggtgggatatttctctcaactttcctagctgcaacttgtgataatttgtgagacacattaagcactcaagaagggtttgattctgtagacaaaacccggggtcagacagtccacagcttcagcatagtgtgttcactatatctaaagtaggttttacttctttaagattaattttgttcttagacagtttcccacatgcagcacaaagcagttatgttttaattttataggctacaatgacggtatttcaaaaagtaagatgtgggagttacaccttgaatgatcacccaaggattgttggccatcagcactgaatggcccagaaccaatctacagcaaatctgagagagcagagacatgctgctccactgtctgagggcccttgcccatggtggttgctattgacatcttgacaggatctaaaatcacctaggtgtgctctgggcacctctggacatatctgggagtctctagactggattgcctgaggttgatttaaaaaccctaactgggcagcaccattcattgggatggggtcctggcgtggataaagattggaggatgagggagcaccaggttccacctctctgcctcctgactggatgcagcatgatcagctccctctcctgctgtgacacaatctctgtaccctcaaactgaacaaaacaagctcactcgaaagttgctttcgttagtcactttgtcacagctttgtcacagtgatgagaaaaataacacacaccccccaaatgaggattggatcgaggccctgggcatgctgggtaaactcttcaccactaagctatattcctaaccctttttactttgaatagggtcttaattgcccagattggccttaaaatgataattctcctgtcttcagcttcccaagcagctggaattacaaatgcgagcactagtatgtatatgtagtatataaataatatattgtacatatattcacatgtgtgtgtacatgtgtgtacacaattacaaatgggagccccagaatgatgtatacacatacatataagtaggtaattaatatatacatatttacacatattatactagtgtgtatatatagaatatataatatgtattgcacatatattcacatatgtgtgtacatgtccatgtcacattgtgattgctagttaaataccacttttccctgctctctaatccaagtagcaattgaacctgtgaattatggtaaacttcaggggattgaaaagcctgacctccacagaatcagctaacgttagctgctactatgattccaagcagtagttactggaagtgtttgctcctgtattctcttggaaggaagaactagattgttagtcatcagttcacagtcggttatggtccccctgttggcctcatagaccagaaagtagagttgcatggtttgattgtaaagtgacccacctcccacaggttcacatgcttgaacactgggtccccagatgatggagctcttgggggaggttgtggagaccatctaggaggttagcttacctggaggaaatgggcttctaggggacagacattgaagatgataggttttccctgtttctgccctgggaatatatccaaattcctcactcgaatgccacagccctgagatgagccttccccttcacagtggactctaccctcaaaccctgagccagagtagatccttcgtcctttgctagatgtttggtcacggcagtgaggtaaagtaccgagcacagcatcattgttcccattttacggatgggaaaactgagccttgggagatgcccaaggctgtcagccttgagtgtttaaaagctgcaaggattggatgcatttgtcctatatcagggaaacatgatggggatggagtctgggtgctgaggcactgagttggcaagagggaaggcctggtgttcactcaaagtcattaaggaccaattgtgtctgcaatcctgtgccctcccttgaacaataggtaagggtcagtgtgagccctgattactcccagcagaaggatacatctgctttggagaccaaagtcccttcactgtagaaactaggtccttcaaggtctcagataaaaagacaatgggttttgtgctaatttccacccaatgggtgtgtgggtcacactactcactgggccaacatggtggtctggacagtcacacaggatgaagtgaggaaaggcaagtctccccggcacctcccctatcgtcactgcaaggccaccctgactaagagtcccctcttcaatgctggccctacgaatatcttatcactcttcgtgtttacaagatttctctccttggaaggtgtgatgtggacagtgaagctctcaacaacccctactcacctaagacctagacaagagagtctgggatggccatgtatgtactccttcagtaattgacagccattttctttgtctaggaagtcttcctacaagcttccgcaccataacggtatcggctgtcctgatttacagacatgtcattgggactgatatctgcaacaaagagcagatctccagtcactcatctcactccagcttgttcacagaacaaaaaggagttgaagggaggtcttcatcattgggtgttcccttccatggagcataggacaggcatggtgcccagaacctgcccagcttctagctctccaagcctcatgctttcctgtctcnaaaaaaaaaaaaaaaaaaa

SEQ ID NO: 184 - DNA, 1381 bp, Mus musculus
  CDS (45)..(1109)
gagccgagaggatgctgctgtccctggtgctccacacgtactctatgcgctacctgctccccagcgtcctgttgctgggctcggcgcccacctacctgctggcctggacgctgtggcgggtgctctccgcgctgatgcccgcccgcctgtaccagcgcgtggacgaccggctttactgcgtctaccagaacatggtgctcttcttcttcgagaactacaccggggtccagatattgctatatggagatttgccaaaaaataaagaaaatgtaatatatctagcgaatcatcaaagcacagttgactggattgttgcggacatgctggctgccagacaggatgccctaggacatgtgcgctacgtactgaaagacaagttaaaatggcttccgctgtatgggttctactttgctcagcatggaggaatttatgtaaaacgaagtgccaaatttaatgataaagaaatgagaagcaagctgcagagctatgtgaacgcaggaacaccgatgtatcttgtgattttcccagagggaacaaggtataatgcaacatacacaaaactcctttcagccagtcaggcatttgctgctcagcggggccttgcagtattaaaacacgtactgacaccaagaataaaggccactcacgttgcttttgattctatgaagagtcatttagatgcaatttatgatgtcacagtggtttatgaagggaatgagaaaggttcaggaaaatactcaaatccaccatccatgactgagtttctctgcaaacagtgcccaaaacttcatattcactttgatcgtatagacagaaatgaagttccagaggaacaagaacacatgaaaaagtggcttcatgagcgctttgagataaaagataggttgctcatagagttctatgattcaccagatccagaaagaagaaacaaatttcctgggaaaagtgttcattccagactaagtgtgaagaagactttaccttcagtgttgatcttggggagtttgactgcggtcatgctgatgacggagtccggaaggaaactgtacatgggcacctggttgtatggaaccctccttggctgcctgtggtttgttattaaagcataagcaagtagcaggctgcagtcacagtctcttattgatggctacacattgtatcacattgtttcctgaattaaataaggagttttcttgttgttgttttttttgttttgttttgttctgttttaagccttgatgattgaacactggataaagtcgagtcttgtgaccacagccaacatgcatttgatttggggcaaacacatgtggcttttcaggtgctggggttgctggagacatggaagctaagtggagtttatgctgtttttttttttttt

SEQ ID NO: 185 - DNA, 47 bp, Homo sapiens
  allele (1)..(47): polymorphic fragment 4-14-107
  allele (24)..(24): polymorphic base A
  primer_bind (1)..(23): potential microsequencing oligo 4-14-107.mis1
  primer_bind (25)..(47): complement potential microsequencing oligo 4-14-107.mis2
ctaaacaaccaccaaatgcatacagcaaccaggcaaatgcctgatag

SEQ ID NO: 186 - DNA, 47 bp, Homo sapiens
  allele (1)..(47): polymorphic fragment 4-14-317
  allele (24)..(24): polymorphic base A
  primer_bind (1)..(23): potential microsequencing oligo 4-14-317.mis1
  primer_bind (25)..(47): complement potential microsequencing oligo 4-14-317.mis2
cataacatgcaaggtgggcaagaaaaagaggtgggcacagctcatga

SEQ ID NO: 187 - DNA, 47 bp, Homo sapiens
  allele (1)..(47): polymorphic fragment 4-14-35
  allele (24)..(24): polymorphic base C
  primer_bind (1)..(23): potential microsequencing oligo 4-14-35.mis1
  primer_bind (25)..(47): complement potential microsequencing oligo 4-14-35.mis2
atccaacacagaaaccgctaaaaccaggcagaagctgtctgcagaga

SEQ ID NO: 188 - DNA, 47 bp, Homo sapiens
  allele (1)..(47): polymorphic fragment 4-20-149
  allele (24)..(24): polymorphic base C
  primer_bind (1)..(23): potential microsequencing oligo 4-20-149.mis1
  primer_bind (25)..(47): complement potential microsequencing oligo 4-20-149.mis2
tttttgctgtgtcttcaaagtgactcttggtttattgcctgctaagg

SEQ ID NO: 189 - DNA, 47 bp, Homo sapiens
  allele (1)..(47): polymorphic fragment 4-20-77
  allele (24)..(24): polymorphic base A
  primer_bind (1)..(23): potential microsequencing oligo 4-20-77.mis1
  primer_bind (25)..(47): complement potential microsequencing oligo 4-20-77.mis2
tgcaacatgaagattctgaagggactttgttgtctgagaacacatct

SEQ ID NO: 190 - DNA, 47 bp, Homo sapiens
  allele (1)..(47): polymorphic fragment 4-22-174
  allele (24)..(24): polymorphic base A
  primer_bind (1)..(23): potential microsequencing oligo 4-22-174.mis1
  primer_bind (25)..(47): complement potential microsequencing oligo 4-22-174.mis2
ggattgtgcagaagttgcctttcatgttcaaaaatgttaatttgttt

SEQ ID NO: 191 - DNA, 47 bp, Homo sapiens
  allele (1)..(47): polymorphic fragment 4-22-176
  allele (24)..(24): polymorphic base A
  primer_bind (1)..(23): potential microsequencing oligo 4-22-176.mis1
  primer_bind (25)..(47): complement potential microsequencing oligo 4-22-176.mis2
attgtgcagaagttgcctttcatattcaaaaatgttaatttgtttgt

SEQ ID NO: 192 - DNA, 47 bp, Homo sapiens
  allele (1)..(47): polymorphic fragment 4-26-60
  allele (24)..(24): polymorphic base A
  primer_bind (1)..(23): potential microsequencing oligo 4-26-60.mis1
  primer_bind (25)..(47): complement potential microsequencing oligo 4-26-60.mis2
gatgggaaagtgcatcttaagacagttagcaggccaaggagcgactt

SEQ ID NO: 193 - DNA, 47 bp, Homo sapiens
  allele (1)..(47): polymorphic fragment 4-26-72
  allele (24)..(24): polymorphic base A
  primer_bind (1)..(23): potential microsequencing oligo 4-26-72.mis1
  primer_bind (25)..(47): complement potential microsequencing oligo 4-26-72.mis2
catcttaagacagttagcaggccaaggagcgactttaaagggtgagc

SEQ ID NO: 194 - DNA, 47 bp, Homo sapiens
  allele (1)..(47): polymorphic fragment 4-3-130
  allele (24)..(24): polymorphic base A
  primer_bind (1)..(23): potential microsequencing oligo 4-3-130.mis1
  primer_bind (25)..(47): complement potential microsequencing oligo 4-3-130.mis2
tattgggcctaaaacagtattctataaagcttaaattggtattaact

SEQ ID NO: 195 - DNA, 47 bp, Homo sapiens
  allele (1)..(47): polymorphic fragment 4-38-63
  allele (24)..(24): polymorphic base A
  primer_bind (1)..(23): potential microsequencing oligo 4-38-63.mis1
  primer_bind (25)..(47): complement potential microsequencing oligo 4-38-63.mis2
tataagttataagaaaatcaggcagaggctaaactttttttttgttt

SEQ ID NO: 196 - DNA, 47 bp, Homo sapiens
  allele (1)..(47): polymorphic fragment 4-38-83
  allele (24)..(24): polymorphic base G
  primer_bind (1)..(23): potential microsequencing oligo 4-38-83.mis1
  primer_bind (25)..(47): complement potential microsequencing oligo 4-38-83.mis2
ggcagaggctaaactttttttttgtttggcaatgctgttgagaatat

SEQ ID NO: 197 - DNA, 47 bp, Homo sapiens
  allele (1)..(47): polymorphic fragment 4-4-152
  allele (24)..(24): polymorphic base C
  primer_bind (1)..(23): potential microsequencing oligo 4-4-152.mis1
  primer_bind (25)..(47): complement potential microsequencing oligo 4-4-152.mis2
tactttcccattgttcctgacttcgttatcctatatataaacagaaa

SEQ ID NO: 198 - DNA, 47 bp, Homo sapiens
  allele (1)..(47): polymorphic fragment 4-4-187
  allele (24)..(24): polymorphic base A
  primer_bind (1)..(23): potential microsequencing oligo 4-4-187.mis1
  primer_bind (25)..(47): complement potential microsequencing oligo 4-4-187.mis2
tataaacagaaacatggatgagtaaaaaaaaaaaaaaaaaaaaaaaa

SEQ ID NO: 199 - DNA, 47 bp, Homo sapiens
  allele (1)..(47): polymorphic fragment 4-4-288
  allele (24)..(24): polymorphic base G
  primer_bind (1)..(23): potential microsequencing oligo 4-4-288.mis1
  primer_bind (25)..(47): complement potential microsequencing oligo 4-4-288.mis2
ctgtcatcaactaattttcacaagtacctatgttttgatttcatgta

SEQ ID NO: 200 - DNA, 47 bp, Homo sapiens
  allele (1)..(47): polymorphic fragment 4-42-304
  allele (24)..(24): polymorphic base C
  primer_bind (1)..(23): potential microsequencing oligo 4-42-304.mis1
  primer_bind (25)..(47): complement potential microsequencing oligo 4-42-304.mis2
attatttaaaactatttatgtaaccttattttcaggggtttttaatt

SEQ ID NO: 201 - DNA, 47 bp, Homo sapiens
  allele (1)..(47): polymorphic fragment 4-42-401
  allele (24)..(24): polymorphic base A
  primer_bind (1)..(23): potential microsequencing oligo 4-42-401.mis1
  primer_bind (25)..(47): complement potential microsequencing oligo 4-42-401.mis2
taagaaagaattctgtgttctggacaaagtttaaacccacagagcca

SEQ ID NO: 202 - DNA, 47 bp, Homo sapiens
  allele (1)..(47): polymorphic fragment 4-43-328
  allele (24)..(24): polymorphic base C
  primer_bind (1)..(23): potential microsequencing oligo 4-43-328.mis1
  primer_bind (25)..(47): complement potential microsequencing oligo 4-43-328.mis2
agaattctgtgttctggccaaagcttaaacccacagagccagtttaa

SEQ ID NO: 203 - DNA, 48 bp, Homo sapiens
  allele (1)..(47): polymorphic fragment 4-43-70
  allele (24)..(24): polymorphic base G
  primer_bind (1)..(23): potential microsequencing oligo 4-43-70.mis1
  primer_bind (25)..(47): complement potential microsequencing oligo 4-43-70.mis2
atcgcctccattattctcaaaaagaccatgggacacaacacaagaags

SEQ ID NO: 204 - DNA, 47 bp, Homo sapiens
  allele (1)..(47): polymorphic fragment 4-50-209
  allele (24)..(24): polymorphic base C
  primer_bind (1)..(23): potential microsequencing oligo 4-50-209.mis1
  primer_bind (25)..(47): complement potential microsequencing oligo 4-50-209.mis2
atatagagtgtgcatccctgacactgaaactgaaggctttatggttt

SEQ ID NO: 205 - DNA, 47 bp, Homo sapiens
  allele (1)..(47): polymorphic fragment 4-50-293
  allele (24)..(24): polymorphic base G
  primer_bind (1)..(23): potential microsequencing oligo 4-50-293.mis1
  primer_bind (25)..(47): complement potential microsequencing oligo 4-50-293.mis2
cctgagtcccagggggctgacaggggacagtttaaaacattgatgaa

SEQ ID NO: 206 - DNA, 47 bp, Homo sapiens
  allele (1)..(47): polymorphic fragment 4-50-323
  allele (24)..(24): polymorphic base C
  primer_bind (1)..(23): potential microsequencing oligo 4-50-323.mis1
  primer_bind (25)..(47): complement potential microsequencing oligo 4-50-323.mis2
tttaaaacattgatgaatctttactactacaaaagggttcgatttag

SEQ ID NO: 207 - DNA, 47 bp, Homo sapiens
  allele (1)..(47): polymorphic fragment 4-50-329
  allele (24)..(24): polymorphic base C
  primer_bind (1)..(23): potential microsequencing oligo 4-50-329.mis1
  primer_bind (25)..(47): complement potential microsequencing oligo 4-50-329.mis2
acattgatgaatctttattactacaaaagggttcgatttaggctagc

SEQ ID NO: 208 - DNA, 47 bp, Homo sapiens
  allele (1)..(47): polymorphic fragment 4-50-330
  allele (24)..(24): polymorphic base A
  primer_bind (1)..(23): potential microsequencing oligo 4-50-330.mis1
  primer_bind (25)..(47): complement potential microsequencing oligo 4-50-330.mis2
cattgatgaatctttattactacaaaagggttcgatttaggctagcc

SEQ ID NO: 209 - DNA, 47 bp, Homo sapiens
  allele (1)..(47): polymorphic fragment 4-52-163
  allele (24)..(24): polymorphic base A
  primer_bind (1)..(23): potential microsequencing oligo 4-52-163.mis1
  primer_bind (25)..(47): complement potential microsequencing oligo 4-52-163.mis2
gaacaggatattcttaactaccaaagaattttacacatctattgttt

SEQ ID NO: 210 - DNA, 47 bp, Homo sapiens
  allele (1)..(47): polymorphic fragment 4-52-88
  allele (24)..(24): polymorphic base C
  primer_bind (1)..(23): potential microsequencing oligo 4-52-88.mis1
  primer_bind (25)..(47): complement potential microsequencing oligo 4-52-88.mis2
tccatgtcattattattcaaaagcttaaaaaatacacaaggtgaaaa

SEQ ID NO: 211 - DNA, 47 bp, Homo sapiens
  allele (1)..(47): polymorphic fragment 4-53-258
  allele (24)..(24): polymorphic base A
  primer_bind (1)..(23): potential microsequencing oligo 4-53-258.mis1
  primer_bind (25)..(47): complement potential microsequencing oligo 4-53-258.mis2
gagaaatcatgcagagagaatgcattctcactcaaattttaacctaa

SEQ ID NO: 212 - DNA, 47 bp, Homo sapiens
  allele (1)..(47): polymorphic fragment 4-54-283
  allele (24)..(24): polymorphic base A
  primer_bind (1)..(23): potential microsequencing oligo 4-54-283.mis1
  primer_bind (25)..(47): complement potential microsequencing oligo 4-54-283.mis2
aagtagtttttcacactttctctatgatacaatcgatggcttaatct

SEQ ID NO: 213 - DNA, 47 bp, Homo sapiens
  allele (1)..(47): polymorphic fragment 4-54-388
  allele (24)..(24): polymorphic base A
  primer_bind (1)..(23): potential microsequencing oligo 4-54-388.mis1
  primer_bind (25)..(47): complement potential microsequencing oligo 4-54-388.mis2
ctctctatcgtatacatctttacacacgctgcagcgccaagactcca

SEQ ID NO: 214 - DNA, 47 bp, Homo sapiens
  allele (1)..(47): polymorphic fragment 4-55-70
  allele (24)..(24): polymorphic base A
  primer_bind (1)..(23): potential microsequencing oligo 4-55-70.mis1
  primer_bind (25)..(47): complement potential microsequencing oligo 4-55-70.mis2
tattaagaacctaggttttaaaaaactctctatcgtatacatcttta

SEQ ID NO: 215 - DNA, 47 bp, Homo sapiens; identical to SEQ ID NO: 213
  allele (1)..(47): polymorphic fragment 4-55-95
  allele (24)..(24): polymorphic base A
  primer_bind (1)..(23): potential microsequencing oligo 4-55-95.mis1
  primer_bind (25)..(47): complement potential microsequencing oligo 4-55-95.mis2

SEQ ID NO: 216 - DNA, 47 bp, Homo sapiens
  allele (1)..(47): polymorphic fragment 4-56-159
  allele (24)..(24): polymorphic base C
  primer_bind (1)..(23): potential microsequencing oligo 4-56-159.mis1
  primer_bind (25)..(47): complement potential microsequencing oligo 4-56-159.mis2
aagttttccttctcttctgtagacgtctccatgttacagtcaactat

SEQ ID NO: 217 - DNA, 47 bp, Homo sapiens
  allele (1)..(47): polymorphic fragment 4-56-213
  allele (24)..(24): polymorphic base A
  primer_bind (1)..(23): potential microsequencing oligo 4-56-213.mis1
  primer_bind (25)..(47): complement potential microsequencing oligo 4-56-213.mis2
atggctcatgttcactctggttcaccttcagaggagtttgatatttt

SEQ ID NO: 218 - DNA, 47 bp, Homo sapiens
  allele (1)..(47): polymorphic fragment 4-58-289
  allele (24)..(24): polymorphic base G
  primer_bind (1)..(23): potential microsequencing oligo 4-58-289.mis1
  primer_bind (25)..(47): complement potential microsequencing oligo 4-58-289.mis2
catacctgcagcctgcttttggtgaggggtgactactttacctgcaa

SEQ ID NO: 219 - DNA, 47 bp, Homo sapiens
  allele (1)..(47): polymorphic fragment 4-58-318
  allele (24)..(24): polymorphic base A
  primer_bind (1)..(23): potential microsequencing oligo 4-58-318.mis1
  primer_bind (25)..(47): complement potential microsequencing oligo 4-58-318.mis2
tgactactttacctgcaatatttatttgcaagtttatttcttccttt

SEQ ID NO: 220 - DNA, 47 bp, Homo sapiens
  allele (1)..(47): polymorphic fragment 4-60-266
  allele (24)..(24): polymorphic base G
  primer_bind (1)..(23): potential microsequencing oligo 4-60-266.mis1
  primer_bind (25)..(47): complement potential microsequencing oligo 4-60-266.mis2
aacaggaccaagacactgcattagataaagtttcagtatttcttagc

SEQ ID NO: 221 - DNA, 47 bp, Homo sapiens
  allele (1)..(47): polymorphic fragment 4-60-293
  allele (24)..(24): polymorphic base C
  primer_bind (1)..(23): potential microsequencing oligo 4-60-293.mis1
  primer_bind (25)..(47): complement potential microsequencing oligo 4-60-293.mis2
aagtttcagtatttcttagcagacgaagccagcaggaagtcctccta

SEQ ID NO: 222 - DNA, 47 bp, Homo sapiens
  allele (1)..(47): polymorphic fragment 4-84-241
  allele (24)..(24): polymorphic base G
  primer_bind (1)..(23): potential microsequencing oligo 4-84-241.mis1
  primer_bind (25)..(47): complement potential microsequencing oligo 4-84-241.mis2
gaaaaaaaaatagtgactgccacggtgaataattcagttcttcagaa

SEQ ID NO: 223 - DNA, 47 bp, Homo sapiens
  allele (1)..(47): polymorphic fragment 4-84-262
  allele (24)..(24): polymorphic base A
  primer_bind (1)..(23): potential microsequencing oligo 4-84-262.mis1
  primer_bind (25)..(47): complement potential microsequencing oligo 4-84-262.mis2
acggtgaataattcagttcttcaaaagcagcaacatgatctcatgga

SEQ ID NO: 224 - DNA, 47 bp, Homo sapiens
  allele (1)..(47): polymorphic fragment 4-86-206
  allele (24)..(24): polymorphic base A
  primer_bind (1)..(23): potential microsequencing oligo 4-86-206.mis1
  primer_bind (25)..(47): complement potential microsequencing oligo 4-86-206.mis2
gtattcaaatcaggacacaccacaaatggcatctacacgttaacatt

SEQ ID NO: 225 - DNA, 47 bp, Homo sapiens
  allele (1)..(47): polymorphic fragment 4-86-309
  allele (24)..(24): polymorphic base A
  primer_bind (1)..(23): potential microsequencing oligo 4-86-309.mis1
  primer_bind (25)..(47): complement potential microsequencing oligo 4-86-309.mis2
tggctctaggcaggccactttagagagtgaggaaccagagagcagaa

SEQ ID NO: 226 - DNA, 47 bp, Homo sapiens
  allele (1)..(47): polymorphic fragment 4-88-349
  allele (24)..(24): polymorphic base G
  primer_bind (1)..(23): potential microsequencing oligo 4-88-349.mis1
  primer_bind (25)..(47): complement potential microsequencing oligo 4-88-349.mis2
gaaactaaaagacaatattcagtgtgagattttccaagttctttatg

SEQ ID NO: 227 - DNA, 47 bp, Homo sapiens
  allele (1)..(47): polymorphic fragment 4-89-87
  allele (24)..(24): polymorphic base C
  primer_bind (1)..(23): potential microsequencing oligo 4-89-87.mis1
  primer_bind (25)..(47): complement potential microsequencing oligo 4-89-87.mis2
ttcttccctgaacgctggtttcacatagtttttgtgttgagaataga

SEQ ID NO: 228 - DNA, 47 bp, Homo sapiens
  allele (1)..(47): polymorphic fragment 99-123-184
  allele (24)..(24): polymorphic base G
  primer_bind (1)..(23): potential microsequencing oligo 99-123-184.mis1
  primer_bind (25)..(47): complement potential microsequencing oligo 99-123-184.mis2
ccagcccagaacattcaccagctgggccaagagttctgctgggtttt

SEQ ID NO: 229 - DNA, 47 bp, Homo sapiens
  allele (1)..(47): polymorphic fragment 99-128-202
  allele (24)..(24): polymorphic base A
  primer_bind (1)..(23): potential microsequencing oligo 99-128-202.mis1
  primer_bind (25)..(47): complement potential microsequencing oligo 99-128-202.mis2
aatgtctgtttcttagagaactgaaacacacacacatacatacacac

SEQ ID NO: 230 - DNA, 47 bp, Homo sapiens
  allele (1)..(47): polymorphic fragment 99-128-275
  allele (24)..(24): polymorphic base A
  primer_bind (1)..(23): potential microsequencing oligo 99-128-275.mis1
  primer_bind (25)..(47): complement potential microsequencing oligo 99-128-275.mis2
acacccctacctcacatgtgtagacaaatgtatgcatatatgtctct

SEQ ID NO: 231 - DNA, 47 bp, Homo sapiens
  allele (1)..(47): polymorphic fragment 99-128-313
  allele (24)..(24): polymorphic base A
  primer_bind (1)..(23): potential microsequencing oligo 99-128-313.mis1
  primer_bind (25)..(47): complement potential microsequencing oligo 99-128-313.mis2
tatgtctctagacagatatacataagattctatttggcatagaaaaa

SEQ ID NO: 232 - DNA, 47 bp, Homo sapiens
  allele (1)..(47): polymorphic fragment 99-128-60
  allele (24)..(24): polymorphic base C
  primer_bind (1)..(23): potential microsequencing oligo 99-128-60.mis1
  primer_bind (25)..(47): complement potential microsequencing oligo 99-128-60.mis2
gcactgtgacccaggcgctaggtccctcttacagtgacactccgaca

SEQ ID NO: 233 - DNA, 47 bp, Homo sapiens
  allele (1)..(47): polymorphic fragment 99-12907-295
  allele (24)..(24): polymorphic base A
  primer_bind (1)..(23): potential microsequencing oligo 99-12907-295.mis1
  primer_bind (25)..(47): complement potential microsequencing oligo 99-12907-295.mis2
gctatatggcattatatctccacagggcagacctgatgtacaagatg

SEQ ID NO: 234 - DNA, 47 bp, Homo sapiens
  allele (1)..(47): polymorphic fragment 99-130-58
  allele (24)..(24): polymorphic base C
  primer_bind (1)..(23): potential microsequencing oligo 99-130-58.mis1
  primer_bind (25)..(47): complement potential microsequencing oligo 99-130-58.mis2
aaagcaaaagagcttcaaaaatacttcaggagtgtgcatatggcgag

SEQ ID NO: 235 - DNA, 47 bp, Homo sapiens
  allele (1)..(47): polymorphic fragment 99-134-362
  allele (24)..(24): polymorphic base G
  primer_bind (1)..(23): potential microsequencing oligo 99-134-362.mis1
  primer_bind (25)..(47): complement potential microsequencing oligo 99-134-362.mis2
caaaacactcatgttagttagatgattattcctattacaaagataag

SEQ ID NO: 236 - DNA, 47 bp, Homo sapiens
  allele (1)..(47): polymorphic fragment 99-140-130
  allele (24)..(24): polymorphic base C
  primer_bind (1)..(23): potential microsequencing oligo 99-140-130.mis1
  primer_bind (25)..(47): complement potential microsequencing oligo 99-140-130.mis2
tgttcaaaagcagctacagaccacatgtaaacaattgagcatggctg

SEQ ID NO: 237 - DNA, 47 bp, Homo sapiens
  allele (1)..(47): polymorphic fragment 99-1462-238
  allele (24)..(24): polymorphic base G
  primer_bind (1)..(23): potential microsequencing oligo 99-1462-238.mis1
  primer_bind (25)..(47): complement potential microsequencing oligo 99-1462-238.mis2
ccctttcaaggttagtaactcatgtgctgtgtttctgcttcagaagg

SEQ ID NO: 238 - DNA, 47 bp, Homo sapiens
  allele (1)..(47): polymorphic fragment 99-147-181
  allele (24)..(24): polymorphic base A
  primer_bind (1)..(23): potential microsequencing oligo 99-147-181.mis1
  primer_bind (25)..(47): complement potential microsequencing oligo 99-147-181.mis2
gtgtcatgaaaaagagcatgataaaaagaaaaacttaaatctttata

SEQ ID NO: 239 - DNA, 47 bp, Homo sapiens
  allele (1)..(47): polymorphic fragment 99-1474-156
  allele (24)..(24): polymorphic base G
  primer_bind (1)..(23): potential microsequencing oligo 99-1474-156.mis1
  primer_bind (25)..(47): complement potential microsequencing oligo 99-1474-156.mis2
cttgtactcataagttaaatattgataacaagaagaaatatggactt

SEQ ID NO: 240 - DNA, 47 bp, Homo sapiens
  allele (1)..(47): polymorphic fragment 99-1474-359
  allele (24)..(24): polymorphic base A
  primer_bind (1)..(23): potential microsequencing oligo 99-1474-359.mis1
  primer_bind (25)..(47): complement potential microsequencing oligo 99-1474-359.mis2
aaaaaaaatcaaattattgtaccaaattccctaatatcagatgtgta

SEQ ID NO: 241 - DNA, 47 bp, Homo sapiens
  allele (1)..(47): polymorphic fragment 99-1479-158
  allele (24)..(24): polymorphic base C
  primer_bind (1)..(23): potential microsequencing oligo 99-1479-158.mis1
  primer_bind (25)..(47): complement potential microsequencing oligo 99-1479-158.mis2
tttaaaaatccacttgtaatcgccgctaattggagtgtatattcagg

SEQ ID NO: 242 - DNA, 47 bp, Homo sapiens
  allele (1)..(47): polymorphic fragment 99-1479-379
  allele (24)..(24): polymorphic base A
  primer_bind (1)..(23): potential microsequencing oligo 99-1479-379.mis1
  primer_bind (25)..(47): complement potential microsequencing oligo 99-1479-379.mis2
gtagagctgtgtactgaggtcagagaagcagctcatggtacagcctt

SEQ ID NO: 243 - DNA, 47 bp, Homo sapiens
  allele (1)..(47): polymorphic fragment 99-148-129
  allele (24)..(24): polymorphic base A
  primer_bind (1)..(23): potential microsequencing oligo 99-148-129.mis1
  primer_bind (25)..(47): complement potential microsequencing oligo 99-148-129.mis2
ttcatatctatacaaataattttaaatttaatacatagggctgcaaa

SEQ ID NO: 244 - DNA, 47 bp, Homo sapiens
  allele (1)..(47): polymorphic fragment 99-148-132
  allele (24)..(24): polymorphic base C
  primer_bind (1)..(23): potential microsequencing oligo 99-148-132.mis1
  primer_bind (25)..(47): complement potential microsequencing oligo 99-148-132.mis2
atatctatacaaataattttgaacttaatacatagggctgcaaaaca

SEQ ID NO: 245 - DNA, 47 bp, Homo sapiens
  allele (1)..(47): polymorphic fragment 99-148-139
  allele (24)..(24): polymorphic base C
  primer_bind (1)..(23): potential microsequencing oligo 99-148-139.mis1
  primer_bind (25)..(47): complement potential microsequencing oligo 99-148-139.mis2
tacaaataattttgaatttaatacatagggctgcaaaacaaggttga

SEQ ID NO: 246 - DNA, 47 bp, Homo sapiens
  allele (1)..(47): polymorphic fragment 99-148-140
  allele (24)..(24): polymorphic base A
  primer_bind (1)..(23): potential microsequencing oligo 99-148-140.mis1
  primer_bind (25)..(47): complement potential microsequencing oligo 99-148-140.mis2
acaaataattttgaatttaatacatagggctgcaaaacaaggttgat

SEQ ID NO: 247 - DNA, 47 bp, Homo sapiens
  allele (1)..(47): polymorphic fragment 99-148-182
  allele (24)..(24): polymorphic base A
  primer_bind (1)..(23): potential microsequencing oligo 99-148-182.mis1
  primer_bind (25)..(47): complement potential microsequencing oligo 99-148-182.mis2
ttgatgttgatatgggcaactgtatgttggatggtcccaaagcattc

SEQ ID NO: 248 - DNA, 47 bp, Homo sapiens
  allele (1)..(47): polymorphic fragment 99-148-366
  allele (24)..(24): polymorphic base G
  primer_bind (1)..(23): potential microsequencing oligo 99-148-366.mis1
  primer_bind (25)..(47): complement potential microsequencing oligo 99-148-366.mis2
tccttgtcaaaggtctctccctggtgctcacggctgccgcctcaaag

SEQ ID NO: 249 - DNA, 47 bp, Homo sapiens
  allele (1)..(47): polymorphic fragment 99-148-76
  allele (24)..(24): polymorphic base C
  primer_bind (1)..(23): potential microsequencing oligo 99-148-76.mis1
  primer_bind (25)..(47): complement potential microsequencing oligo 99-148-76.mis2
tgatagaatgccttcctgaattactactcttgatggcttcataaaac

SEQ ID NO: 250 - DNA, 47 bp, Homo sapiens
  allele (1)..(47): polymorphic fragment 99-1480-290
  allele (24)..(24): polymorphic base G
  primer_bind (1)..(23): potential microsequencing oligo 99-1480-290.mis1
  primer_bind (25)..(47): complement potential microsequencing oligo 99-1480-290.mis2
tgcaccatcttcaccacaaccccgggcaaccactgatccttttactg

SEQ ID NO: 251 - DNA, 47 bp, Homo sapiens
  allele (1)..(47): polymorphic fragment 99-1481-285
  allele (24)..(24): polymorphic base G
  primer_bind (1)..(23): potential microsequencing oligo 99-1481-285.mis1
  primer_bind (25)..(47): complement potential microsequencing oligo 99-1481-285.mis2
tcccataacctgttttgcttctcgctctaacctcaagatggtataaa

SEQ ID NO: 252 - DNA, 47 bp, Homo sapiens
  allele (1)..(47): polymorphic fragment 99-1484-101
  allele (24)..(24): polymorphic base A
  primer_bind (1)..(23): potential microsequencing oligo 99-1484-101.mis1
  primer_bind (25)..(47): complement potential microsequencing oligo 99-1484-101.mis2
aaaaagatcaaatataagcatgtaactcctctccttaaaatctcagt

SEQ ID NO: 253 - DNA, 47 bp, Homo sapiens
  allele (1)..(47): polymorphic fragment 99-1484-328
  allele (24)..(24): polymorphic base G
  primer_bind (1)..(23): potential microsequencing oligo 99-1484-328.mis1
  primer_bind (25)..(47): complement potential microsequencing oligo 99-1484-328.mis2
ggacacgtggtcatgaggagtttgaagggattcagttttcagatccc

SEQ ID NO: 254 - DNA, 47 bp, Homo sapiens
  allele (1)..(47): polymorphic fragment 99-1485-251
  allele (24)..(24): polymorphic base G
  primer_bind (1)..(23): potential microsequencing oligo 99-1485-251.mis1
  primer_bind (25)..(47): complement potential microsequencing oligo 99-1485-251.mis2
gattgccttgatatatgctcccagagaaccaagaatgtccccttttc

SEQ ID NO: 255 - DNA, 47 bp, Homo sapiens
  allele (1)..(47): polymorphic fragment 99-1490-381
  allele (24)..(24): polymorphic base C
  primer_bind (1)..(23): potential microsequencing oligo 99-1490-381.mis1
  primer_bind (25)..(47): complement potential microsequencing oligo 99-1490-381.mis2
tgcacagtggaaataccatgtcacggtacgctactgtgcatctcttc

SEQ ID NO: 256 - DNA, 47 bp, Homo sapiens
  allele (1)..(47): polymorphic fragment 99-1493-280
  allele (24)..(24): polymorphic base A
  primer_bind (1)..(23): potential microsequencing oligo 99-1493-280.mis1
  primer_bind (25)..(47): complement potential microsequencing oligo 99-1493-280.mis2
ggatgacagagtattgttggaggaatggggtttggctgcttgttttt

SEQ ID NO: 257 - DNA, 47 bp, Homo sapiens
  allele (1)..(47): polymorphic fragment 99-151-94
  allele (24)..(24): polymorphic base A
  primer_bind (1)..(23): potential microsequencing oligo 99-151-94.mis1
  primer_bind (25)..(47): complement potential microsequencing oligo 99-151-94.mis2
attgagatcattgataaggaaatattctaaaatttcaaaatctatat

SEQ ID NO: 258 - DNA, 47 bp, Homo sapiens
  allele (1)..(47): polymorphic fragment 99-211-291
  allele (24)..(24): polymorphic base A
  primer_bind (1)..(23): potential microsequencing oligo 99-211-291.mis1
  primer_bind (25)..(47): complement potential microsequencing oligo 99-211-291.mis2
ctggttatatcagactgaccttcatgttttcaacaggtcaatgcctt

SEQ ID NO: 259 - DNA, 45 bp, Homo sapiens
  allele (1)..(45): polymorphic fragment 99-123-37
  allele (23)..(23): polymorphic base T
  primer_bind (1)..(22): potential microsequencing oligo 99-213-37.mis1
  primer_bind (24)..(45): complement potential microsequencing oligo 99-213-37.mis2
gtgcttccggctgcaggactgttggaggactccagtgtctgacag

SEQ ID NO: 260 - DNA, 47 bp, Homo sapiens
  allele (1)..(47): polymorphic fragment 99-221-442
  allele (24)..(24): polymorphic base A
  primer_bind (1)..(23): potential microsequencing oligo 99-221-442.mis1
  primer_bind (25)..(47): complement potential microsequencing oligo 99-221-442.mis2
tgcctttgtagatatgcatgggaattccatgacctagccagacgaat

SEQ ID NO: 261 - DNA, 47 bp, Homo sapiens
  allele (1)..(47): polymorphic fragment 99-222-109
  allele (24)..(24): polymorphic base C
  primer_bind (1)..(23): potential microsequencing oligo 99-222-109.mis1
  primer_bind (25)..(47): complement potential microsequencing oligo 99-222-109.mis2
caggtgaggagtgctggattggccacgatatgaatttcttcagcagt

SEQ ID NO: 262 - DNA, 47 bp, Homo sapiens
  allele (1)..(47): polymorphic fragment 4-14-107, variant version of SEQ ID 185
  allele (24)..(24): polymorphic base G; A in SEQ ID 185
  primer_bind (1)..(23): potential microsequencing oligo 4-14-107.mis1
  primer_bind (25)..(47): complement potential microsequencing oligo 4-14-107.mis2
ctaaacaaccaccaaatgcatacggcaaccaggcaaatgcctgatag

SEQ ID NO: 263 - DNA, 47 bp, Homo sapiens
  allele (1)..(47): polymorphic fragment 4-14-317, variant version of SEQ ID 186
  allele (24)..(24): polymorphic base G; A in SEQ ID 186
  primer_bind (1)..(23): potential microsequencing oligo 4-14-317.mis1
  primer_bind (25)..(47): complement potential microsequencing oligo 4-14-317.mis2
cataacatgcaaggtgggcaagagaaagaggtgggcacagctcatga

SEQ ID NO: 264 - DNA, 47 bp, Homo sapiens
  allele (1)..(47): polymorphic fragment 4-14-35, variant version of SEQ ID 187
  allele (24)..(24): polymorphic base T; C in SEQ ID 187
  primer_bind (1)..(23): potential microsequencing oligo 4-14-35.mis1
  primer_bind (25)..(47): complement potential microsequencing oligo 4-14-35.mis2
atccaacacagaaaccgctaaaatcaggcagaagctgtctgcagaga

SEQ ID NO: 265 - DNA, 47 bp, Homo sapiens
  allele (1)..(47): polymorphic fragment 4-20-149, variant version of SEQ ID 188
  allele (24)..(24): polymorphic base T, C in SEQ ID 188
  primer_bind (1)..(23): potential microsequencing oligo 4-20-149.mis1
  primer_bind (25)..(47): complement potential microsequencing oligo 4-20-149.mis2
tttttgctgtgtcttcaaagtgattcttggtttattgcctgctaagg

SEQ ID NO: 266 - DNA, 47 bp, Homo sapiens
  allele (1)..(47): polymorphic fragment 4-20-77, variant version of SEQ ID 189
  allele (24)..(24): polymorphic base T; A in SEQ ID 189
  primer_bind (1)..(23): potential microsequencing oligo 4-20-77.mis1
  primer_bind (25)..(47): complement potential microsequencing oligo 4-20-77.mis2
tgcaacatgaagattctgaagggtctttgttgtctgagaacacatct

SEQ ID NO: 267 - DNA, 47 bp, Homo sapiens
  allele (1)..(47): polymorphic fragment 4-22-174, variant version of SEQ ID 190
  allele (24)..(24): polymorphic base C; A in SEQ ID 190
  primer_bind (1)..(23): potential microsequencing oligo 4-22-174.mis1
  primer_bind (25)..(47): complement potential microsequencing oligo 4-22-174.mis2
ggattgtgcagaagttgcctttcctgttcaaaaatgttaatttgttt

SEQ ID NO: 268 - DNA, 47 bp, Homo sapiens
  allele (1)..(47): polymorphic fragment 4-22-176, variant version of SEQ ID 191
  allele (24)..(24): polymorphic base G; A in SEQ ID 191
  primer_bind (1)..(23): potential microsequencing oligo 4-22-176.mis1
  primer_bind (25)..(47): complement potential microsequencing oligo 4-22-176.mis2
attgtgcagaagttgcctttcatgttcaaaaatgttaatttgtttgt

SEQ ID NO: 269 - DNA, 47 bp, Homo sapiens
  allele (1)..(47): polymorphic fragment 4-26-60, variant version of SEQ ID 192
  allele (24)..(24): polymorphic base G; A in SEQ ID 192
  primer_bind (1)..(23): potential microsequencing oligo 4-26-60.mis1
  primer_bind (25)..(47): complement potential microsequencing oligo 4-26-60.mis2
gatgggaaagtgcatcttaagacggttagcaggccaaggagcgactt

SEQ ID NO: 270 - DNA, 47 bp, Homo sapiens
  allele (1)..(47): polymorphic fragment 4-26-72, variant version of SEQ ID 193
  allele (24)..(24): polymorphic base G; A in SEQ ID 193
  primer_bind (1)..(23): potential microsequencing oligo 4-26-72.mis1
  primer_bind (25)..(47): complement potential microsequencing oligo 4-26-72.mis2
catcttaagacagttagcaggccgaggagcgactttaaagggtgagc

SEQ ID NO: 271 - DNA, 47 bp, Homo sapiens
  allele (1)..(47): polymorphic fragment 4-3-130, variant version of SEQ ID 194
  allele (24)..(24): polymorphic base G; A in SEQ ID 194
  primer_bind (1)..(23): potential microsequencing oligo 4-3-130.mis1
  primer_bind (25)..(47): complement potential microsequencing oligo 4-3-130.mis2
tattgggcctaaaacagtattctgtaaagcttaaattggtattaact

SEQ ID NO: 272 - DNA, 47 bp, Homo sapiens
  allele (1)..(47): polymorphic fragment 4-38-63, variant version of SEQ ID 195
  allele (24)..(24): polymorphic base G; A in SEQ ID 195
  primer_bind (1)..(23): potential microsequencing oligo 4-38-63.mis1
  primer_bind (25)..(47): complement potential microsequencing oligo 4-38-63.mis2
tataagttataagaaaatcaggcggaggctaaactttttttttgttt

SEQ ID NO: 273 - DNA, 47 bp, Homo sapiens
  allele (1)..(47): polymorphic fragment 4-38-83, variant version of SEQ ID 196
  allele (24)..(24): polymorphic base T; G in SEQ ID 196
  primer_bind (1)..(23): potential microsequencing oligo 4-38-83.mis1
  primer_bind (25)..(47): complement potential microsequencing oligo 4-38-83.mis2
ggcagaggctaaactttttttttttttggcaatgctgttgagaatat

SEQ ID NO: 274 - DNA, 47 bp, Homo sapiens
  allele (1)..(47): polymorphic fragment 4-4-152, variant version of SEQ ID 197
  allele (24)..(24): polymorphic base T; C in SEQ ID 197
  primer_bind (1)..(23): potential microsequencing oligo 4-4-152.mis1
  primer_bind (25)..(47): complement potential microsequencing oligo 4-4-152.mis2
tactttcccattgttcctgactttgttatcctatatataaacagaaa

SEQ ID NO: 275 - DNA, 47 bp, Homo sapiens
  allele (1)..(47): polymorphic fragment 4-4-187, variant version of SEQ ID 198
  allele (24)..(24): polymorphic base T; A in SEQ ID 198
  primer_bind (1)..(23): potential microsequencing oligo 4-4-187.mis1
  primer_bind (25)..(47): complement potential microsequencing oligo 4-4-187.mis2
tataaacagaaacatggatgagttaaaaaaaaaaaaaaaaaaaaaaa

SEQ ID NO: 276 - DNA, 47 bp, Homo sapiens
  allele (1)..(47): polymorphic fragment 4-4-288, variant version of SEQ ID 199
  allele (24)..(24): polymorphic base C; G in SEQ ID 199
  primer_bind (1)..(23): potential microsequencing oligo 4-4-288.mis1
  primer_bind (25)..(47): complement potential microsequencing oligo 4-4-288.mis2
ctgtcatcaactaattttcacaactacctatgttttgatttcatgta

SEQ ID NO: 277 - DNA, 47 bp, Homo sapiens
  allele (1)..(47): polymorphic fragment 4-42-304, variant version of SEQ ID 200
  allele (24)..(24): polymorphic base T; C in SEQ ID 200
  primer_bind (1)..(23): potential microsequencing oligo 4-42-304.mis1
  primer_bind (25)..(47): complement potential microsequencing oligo 4-42-304.mis2
attatttaaaactatttatgtaatcttattttcaggggtttttaatt

SEQ ID NO: 278 - DNA, 47 bp, Homo sapiens
  allele (1)..(47): polymorphic fragment 4-42-401, variant version of SEQ ID 201
  allele (24)..(24): polymorphic base C; A in SEQ ID 201
  primer_bind (1)..(23): potential microsequencing oligo 4-42-401.mis1
  primer_bind (25)..(47): complement potential microsequencing oligo 4-42-401.mis2
taagaaagaattctgtgttctggccaaagtttaaacccacagagcca

SEQ ID NO: 279 - DNA, 47 bp, Homo sapiens
  allele (1)..(47): polymorphic fragment 4-43-328, variant version of SEQ ID 202
  allele (24)..(24): polymorphic base T; C in SEQ ID 202
  primer_bind (1)..(23): potential microsequencing oligo 4-43-328.mis1
  primer_bind (25)..(47): complement potential microsequencing oligo 4-43-328.mis2
agaattctgtgttctggccaaagtttaaacccacagagccagtttaa

SEQ ID NO: 280 - DNA, 47 bp, Homo sapiens
  allele (1)..(47): polymorphic fragment 4-43-70, variant version of SEQ ID 203
  allele (24)..(24): polymorphic base C; G in SEQ ID 203
  primer_bind (1)..(23): potential microsequencing oligo 4-43-70.mis1
  primer_bind (25)..(47): complement potential microsequencing oligo 4-43-70.mis2
atcgcctccattattctcaaaaacaccatgggacacaacacaagaag

SEQ ID NO: 281 - DNA, 47 bp, Homo sapiens
  allele (1)..(47): polymorphic fragment 4-50-209, variant version of SEQ ID 204
  allele (24)..(24): polymorphic base T; C in SEQ ID 204
  primer_bind (1)..(23): potential microsequencing oligo 4-50-209.mis1
  primer_bind (25)..(47): complement potential microsequencing oligo 4-50-209.mis2
atatagagtgtgcatccctgacattgaaactgaaggctttatggttt

SEQ ID NO: 282 - DNA, 47 bp, Homo sapiens
  allele (1)..(47): polymorphic fragment 4-50-293, variant version of SEQ ID 205
  allele (24)..(24): polymorphic base T; G in SEQ ID 205
  primer_bind (1)..(23): potential microsequencing oligo 4-50-293.mis1
  primer_bind (25)..(47): complement potential microsequencing oligo 4-50-293.mis2
cctgagtcccagggggctgacagtggacagtttaaaacattgatgaa

SEQ ID NO: 283 - DNA, 47 bp, Homo sapiens
  allele (1)..(47): polymorphic fragment 4-50-323, variant version of SEQ ID 206
  allele (24)..(24): polymorphic base T; C in SEQ ID 206
  primer_bind (1)..(23): potential microsequencing oligo 4-50-323.mis1
  primer_bind (25)..(47): complement potential microsequencing oligo 4-50-323.mis2
tttaaaacattgatgaatctttattactacaaaagggttcgatttag

SEQ ID NO: 284 - DNA, 47 bp, Homo sapiens
  allele (1)..(47): polymorphic fragment 4-50-329, variant version of SEQ ID 207
  allele (24)..(24): polymorphic base T; C in SEQ ID 207
  primer_bind (1)..(23): potential microsequencing oligo 4-50-329.mis1
  primer_bind (25)..(47): complement potential microsequencing oligo 4-50-329.mis2
acattgatgaatctttattactataaaagggttcgatttaggctagc

SEQ ID NO: 285 - DNA, 47 bp, Homo sapiens
  allele (1)..(47): polymorphic fragment 4-50-330, variant version of SEQ ID 208
  allele (24)..(24): polymorphic base T; A in SEQ ID 208
  primer_bind (1)..(23): potential microsequencing oligo 4-50-330.mis1
  primer_bind (25)..(47): complement potential microsequencing oligo 4-50-330.mis2
cattgatgaatctttattactactaaagggttcgatttaggctagcc

SEQ ID NO: 286 - DNA, 47 bp, Homo sapiens
  allele (1)..(47): polymorphic fragment 4-52-163, variant version of SEQ ID 209
  allele (24)..(24): polymorphic base C; A in SEQ ID 209
  primer_bind (1)..(23): potential microsequencing oligo 4-52-163.mis1
  primer_bind (25)..(47): complement potential microsequencing oligo 4-52-163.mis2
gaacaggatattcttaactaccacagaattttacacatctattgttt

SEQ ID NO: 287 - DNA, 47 bp, Homo sapiens
  allele (1)..(47): polymorphic fragment 4-52-88, variant version of SEQ ID 210
  allele (24)..(24): polymorphic base T; C in SEQ ID 210
  primer_bind (1)..(23): potential microsequencing oligo 4-52-88.mis1
  primer_bind (25)..(47): complement potential microsequencing oligo 4-52-88.mis2
tccatgtcattattattcaaaagtttaaaaaatacacaaggtgaaaa

SEQ ID NO: 288 - DNA, 47 bp, Homo sapiens
  allele (1)..(47): polymorphic fragment 4-53-258, variant version of SEQ ID 211
  allele (24)..(24): polymorphic base G; A in SEQ ID 211
  primer_bind (1)..(23): potential microsequencing oligo 4-53-258.mis1
  primer_bind (25)..(47): complement potential microsequencing oligo 4-53-258.mis2
gagaaatcatgcagagagaatgcgttctcactcaaattttaacctaa

SEQ ID NO: 289 - DNA, 47 bp, Homo sapiens
  allele (1)..(47): polymorphic fragment 4-54-283, variant version of SEQ ID 212
  allele (24)..(24): polymorphic base T; A in SEQ ID 212
  primer_bind (1)..(23): potential microsequencing oligo 4-54-283.mis1
  primer_bind (25)..(47): complement potential microsequencing oligo 4-54-283.mis2
aagtagtttttcacactttctctttgatacaatcgatggcttaatct

SEQ ID NO: 290 - DNA, 47 bp, Homo sapiens
  allele (1)..(47): polymorphic fragment 4-54-388, variant version of SEQ ID 213
  allele (24)..(24): polymorphic base C; A in SEQ ID 213
  primer_bind (1)..(23): potential microsequencing oligo 4-54-388.mis1
  primer_bind (25)..(47): complement potential microsequencing oligo 4-54-388.mis2
ctctctatcgtatacatctttacccacgctgcagcgccaagactcca

SEQ ID NO: 291 - DNA, 47 bp, Homo sapiens
  allele (1)..(47): polymorphic fragment 4-55-70, variant version of SEQ ID 214
  allele (24)..(24): polymorphic base T; A in SEQ ID 214
  primer_bind (1)..(23): potential microsequencing oligo 4-55-70.mis1
  primer_bind (25)..(47): complement potential microsequencing oligo 4-55-70.mis2
tattaagaacctaggttttaaaatactctctatcgtatacatcttta

SEQ ID NO: 292 - DNA, 47 bp, Homo sapiens; identical to SEQ ID NO: 290
  allele (1)..(47): polymorphic fragment 4-55-95, variant version of SEQ ID 215
  allele (24)..(24): polymorphic base C; A in SEQ ID 215
  primer_bind (1)..(23): potential microsequencing oligo 4-55-95.mis1
  primer_bind (25)..(47): complement potential microsequencing oligo 4-55-95.mis2

SEQ ID NO: 293 - DNA, 47 bp, Homo sapiens
  allele (1)..(47): polymorphic fragment 4-56-159, variant version of SEQ ID 216
  allele (24)..(24): polymorphic base T; C in SEQ ID 216
  primer_bind (1)..(23): potential microsequencing oligo 4-56-159.mis1
  primer_bind (25)..(47): complement potential microsequencing oligo 4-56-159.mis2
aagttttccttctcttctgtagatgtctccatgttacagtcaactat

SEQ ID NO: 294 - DNA, 47 bp, Homo sapiens
  allele (1)..(47): polymorphic fragment 4-56-213, variant version of SEQ ID 217
  allele (24)..(24): polymorphic base G; A in SEQ ID 217
  primer_bind (1)..(23): potential microsequencing oligo 4-56-213.mis1
  primer_bind (25)..(47): complement potential microsequencing oligo 4-56-213.mis2
atggctcatgttcactctggttcgccttcagaggagtttgatatttt

SEQ ID NO: 295 - DNA, 47 bp, Homo sapiens
  allele (1)..(47): polymorphic fragment 4-58-289, variant version of SEQ ID 218
  allele (24)..(24): polymorphic base C; G in SEQ ID 218
  primer_bind (1)..(23): potential microsequencing oligo 4-58-289.mis1
  primer_bind (25)..(47): complement potential microsequencing oligo 4-58-289.mis2
catacctgcagcctgcttttggtcaggggtgactactttacctgcaa

SEQ ID NO: 296 - DNA, 47 bp, Homo sapiens
  allele (1)..(47): polymorphic fragment 4-58-318, variant version of SEQ ID 219
  allele (24)..(24): polymorphic base C; A in SEQ ID 219
  primer_bind (1)..(23): potential microsequencing oligo 4-58-318.mis1
  primer_bind (25)..(47): complement potential microsequencing oligo 4-58-318.mis2
tgactactttacctgcaatatttctttgcaagtttatttcttccttt

SEQ ID NO: 297 - DNA, 47 bp, Homo sapiens
  allele (1)..(47): polymorphic fragment 4-60-266, variant version of SEQ ID 220
  allele (24)..(24): polymorphic base T; G in SEQ ID 220
  primer_bind (1)..(23): potential microsequencing oligo 4-60-266.mis1
  primer_bind (25)..(47): complement potential microsequencing oligo 4-60-266.mis2
aacaggaccaagacactgcattatataaagtttcagtatttcttagc

SEQ ID NO: 298 - DNA, 47 bp, Homo sapiens
  allele (1)..(47): polymorphic fragment 4-60-293, variant version of SEQ ID 221
  allele (24)..(24): polymorphic base T; C in SEQ ID 221
  primer_bind (1)..(23): potential microsequencing oligo 4-60-293.mis1
  primer_bind (25)..(47): complement potential microsequencing oligo 4-60-293.mis2
aagtttcagtatttcttagcagatgaagccagcaggaagtcctccta

SEQ ID NO: 299 - DNA, 47 bp, Homo sapiens
  allele (1)..(47): polymorphic fragment 4-84-241, variant version of SEQ ID 222
  allele (24)..(24): polymorphic base T; G in SEQ ID 222
  primer_bind (1)..(23): potential microsequencing oligo 4-84-241.mis1
  primer_bind (25)..(47): complement potential microsequencing oligo 4-84-241.mis2
gaaaaaaaaatagtgactgccactgtgaataattcagttcttcagaa

SEQ ID NO: 300 - DNA, 47 bp, Homo sapiens
  allele (1)..(47): polymorphic fragment 4-84-262, variant version of SEQ ID 223
  allele (24)..(24): polymorphic base G; A in SEQ ID 223
  primer_bind (1)..(23): potential microsequencing oligo 4-84-262.mis1
  primer_bind (25)..(47): complement potential microsequencing oligo 4-84-262.mis2
acggtgaataattcagttcttcagaagcagcaacatgatctcatgga

SEQ ID NO: 301 - DNA, 47 bp, Homo sapiens
  allele (1)..(47): polymorphic fragment 4-86-206, variant version of SEQ ID 224
  allele (24)..(24): polymorphic base G; A in SEQ ID 224
  primer_bind (1)..(23): potential microsequencing oligo 4-86-206.mis1
  primer_bind (25)..(47): complement potential microsequencing oligo 4-86-206.mis2
gtattcaaatcaggacacaccacgaatggcatctacacgttaacatt

SEQ ID NO: 302 - DNA, 47 bp, Homo sapiens
  allele (1)..(47): polymorphic fragment 4-86-309, variant version of SEQ ID 225
  allele (24)..(24): polymorphic base T; A is SEQ ID 225
  primer_bind (1)..(23): potential microsequencing oligo 4-86-309.mis1
  primer_bind (25)..(47): complement potential microsequencing oligo 4-86-309.mis2
tggctctaggcaggccactttagtgagtgaggaaccagagagcagaa

SEQ ID NO: 303 - DNA, 47 bp, Homo sapiens
  allele (1)..(47): polymorphic fragment 4-88-349, variant version of SEQ ID 226
  allele (24)..(24): polymorphic base C; G in SEQ ID 226
  primer_bind (1)..(23): potential microsequencing oligo 4-86-349.mis1
  primer_bind (25)..(47): complement potential microsequencing oligo 4-86-349.mis2
gaaactaaaagacaatattcagtctgagattttccaagttctttatg

SEQ ID NO: 304 - DNA, 47 bp, Homo sapiens
  allele (1)..(47): polymorphic fragment 4-89-87, variant version of SEQ ID 227
  allele (24)..(24): polymorphic base T; C in SEQ ID 227
  primer_bind (1)..(23): potential microsequencing oligo 4-89-87.mis1
  primer_bind (25)..(47): complement potential microsequencing oligo 4-89-87.mis2
ttcttccctgaacgctggtttcatatagtttttgtgttgagaataga

SEQ ID NO: 305 - DNA, 47 bp, Homo sapiens
  allele (1)..(47): polymorphic fragment 99-123-184, variant version of SEQ ID 228
  allele (24)..(24): polymorphic base C; G in SEQ ID 228
  primer_bind (1)..(23): potential microsequencing oligo 99-123-184.mis1
  primer_bind (25)..(47): complement potential microsequencing oligo 99-123-184.mis2
ccagcccagaacattcaccagctcggccaagagttctgctgggtttt

SEQ ID NO: 306 - DNA, 47 bp, Homo sapiens
  allele (1)..(47): polymorphic fragment 99-128-202, variant version of SEQ ID 229
  allele (24)..(24): polymorphic base C; A in SEQ ID 229
  primer_bind (1)..(23): potential microsequencing oligo 99-128-202.mis1
  primer_bind (25)..(47): complement potential microsequencing oligo 99-128-202.mis2
aatgtctgtttcttagagaactgcaacacacacacatacatacacac

SEQ ID NO: 307 - DNA, 47 bp, Homo sapiens
  allele (1)..(47): polymorphic fragment 99-128-275, variant version of SEQ ID 230
  allele (24)..(24): polymorphic base G; A in SEQ ID 230
  primer_bind (1)..(23): potential microsequencing oligo 99-128-275.mis1
  primer_bind (25)..(47): complement potential microsequencing oligo 99-128-275.mis2
acacccctacctcacatgtgtaggcaaatgtatgcatatatgtctct

SEQ ID NO: 308 - DNA, 47 bp, Homo sapiens
  allele (1)..(47): polymorphic fragment 99-128-313, variant version of SEQ ID 231
  allele (24)..(24): polymorphic base G; A in SEQ ID 231
  primer_bind (1)..(23): potential microsequencing oligo 99-128-313.mis1
  primer_bind (25)..(47): complement potential microsequencing oligo 99-128-313.mis2
tatgtctctagacagatatacatgagattctatttggcatagaaaaa

SEQ ID NO: 309 - DNA, 47 bp, Homo sapiens
  allele (1)..(47): polymorphic fragment 99-128-60, variant version of SEQ ID 232
  allele (24)..(24): polymorphic base T; C in SEQ ID 232
  primer_bind (1)..(23): potential microsequencing oligo 99-128-60.mis1
  primer_bind (25)..(47): complement potential microsequencing oligo 99-128-60.mis2
gcactgtgacccaggcgctaggttcctcttacagtgacactccgaca

SEQ ID NO: 310 - DNA, 47 bp, Homo sapiens
  allele (1)..(47): polymorphic fragment 99-12907-295, variant version of SEQ ID 233
  allele (24)..(24): polymorphic base G; A in SEQ ID 233
  primer_bind (1)..(23): potential microsequencing oligo 99-12907-295.mis1
  primer_bind (25)..(47): complement potential microsequencing oligo 99-12907-295.mis2
gctatatggcattatatctccacggggcagacctgatgtacaagatg

SEQ ID NO: 311 - DNA, 47 bp, Homo sapiens
  allele (1)..(47): polymorphic fragment 99-130-58, variant version of SEQ ID 234
  allele (24)..(24): polymorphic base T; C in SEQ ID 234
  primer_bind (1)..(23): potential microsequencing oligo 99-130-58.mis1
  primer_bind (25)..(47): complement potential microsequencing oligo 99-130-58.mis2
aaagcaaaagagcttcaaaaatatttcaggagtgtgcatatggcgag

SEQ ID NO: 312 - DNA, 47 bp, Homo sapiens
  allele (1)..(47): polymorphic fragment 99-134-362, variant version of SEQ ID 235
  allele (24)..(24): polymorphic base T; G in SEQ ID 235
  primer_bind (1)..(23): potential microsequencing oligo 99-134-362.mis1
  primer_bind (25)..(47): complement potential microsequencing oligo 99-134-362.mis2
caaaacactcatgttagttagattattattcctattacaaagataag

SEQ ID NO: 313 - DNA, 47 bp, Homo sapiens
  allele (1)..(47): polymorphic fragment 99-140-130, variant version of SEQ ID 236
  allele (24)..(24): polymorphic base T; C in SEQ ID 236
  primer_bind (1)..(23): potential microsequencing oligo 99-140-130.mis1
  primer_bind (25)..(47): complement potential microsequencing oligo 99-140-130.mis2
tgttcaaaagcagctacagaccatatgtaaacaattgagcatggctg

SEQ ID NO: 314 - DNA, 47 bp, Homo sapiens
  allele (1)..(47): polymorphic fragment 99-1462-238, variant version of SEQ ID 237
  allele (24)..(24): polymorphic base C; G in SEQ ID 237
  primer_bind (1)..(23): potential microsequencing oligo 99-1462-238.mis1
  primer_bind (25)..(47): complement potential microsequencing oligo 99-1462-238.mis2
ccctttcaaggttagtaactcatctgctgtgtttctgcttcagaagg

SEQ ID NO: 315 - DNA, 47 bp, Homo sapiens
  allele (1)..(47): polymorphic fragment 99-147-181, variant version of SEQ ID 238
  allele (24)..(24): polymorphic base G; A in SEQ ID 238
  primer_bind (1)..(23): potential microsequencing oligo 99-147-181.mis1
  primer_bind (25)..(47): complement potential microsequencing oligo 99-147-181.mis2
gtgtcatgaaaaagagcatgatagaaagaaaaacttaaatctttata

SEQ ID NO: 316 - DNA, 47 bp, Homo sapiens
  allele (1)..(47): polymorphic fragment 99-1474-156, variant version of SEQ ID 239
  allele (24)..(24): polymorphic base T; G in SEQ ID 239
  primer_bind (1)..(23): potential microsequencing oligo 99-1474-156.mis1
  primer_bind (25)..(47): complement potential microsequencing oligo 99-1474-156.mis2
cttgtactcataagttaaatatttataacaagaagaaatatggactt

SEQ ID NO: 317 - DNA, 47 bp, Homo sapiens
  allele (1)..(47): polymorphic fragment 99-1474-359, variant version of SEQ ID 240
  allele (24)..(24): polymorphic base G; A in SEQ ID 240
  primer_bind (1)..(23): potential microsequencing oligo 99-1474-359.mis1
  primer_bind (25)..(47): complement potential microsequencing oligo 99-1474-359.mis2
aaaaaaaatcaaattattgtaccgaattccctaatatcagatgtgta

SEQ ID NO: 318 - DNA, 47 bp, Homo sapiens
  allele (1)..(47): polymorphic fragment 99-1479-158, variant version of SEQ ID 241
  allele (24)..(24): polymorphic base T; C in SEQ ID 241
  primer_bind (1)..(23): potential microsequencing oligo 99-1479-158.mis1
  primer_bind (25)..(47): complement potential microsequencing oligo 99-1479-158.mis2
tttaaaaatccacttgtaatcgctgctaattggagtgtatattcagg

SEQ ID NO: 319 - DNA, 47 bp, Homo sapiens
  allele (1)..(47): polymorphic fragment 99-1479-379, variant version of SEQ ID 242
  allele (24)..(24): polymorphic base G; A in SEQ ID 242
  primer_bind (1)..(23): potential microsequencing oligo 99-1479-379.mis1
  primer_bind (25)..(47): complement potential microsequencing oligo 99-1479-379.mis2
gtagagctgtgtactgaggtcagggaagcagctcatggtacagcctt

SEQ ID NO: 320 - DNA, 47 bp, Homo sapiens
  allele (1)..(47): polymorphic fragment 99-148-129, variant version of SEQ ID 243
  allele (24)..(24): polymorphic base G; A in SEQ ID 243
  primer_bind (1)..(23): potential microsequencing oligo 99-148-129.mis1
  primer_bind (25)..(47): complement potential microsequencing oligo 99-148-129.mis2
ttcatatctatacaaataattttgaatttaatacatagggctgcaaa

SEQ ID NO: 321 - DNA, 47 bp, Homo sapiens
  allele (1)..(47): polymorphic fragment 99-148-132, variant version of SEQ ID 244
  allele (24)..(24): polymorphic base T; C in SEQ ID 244
  primer_bind (1)..(23): potential microsequencing oligo 99-148-132.mis1
  primer_bind (25)..(47): complement potential microsequencing oligo 99-148-132.mis2
atatctatacaaataattttgaatttaatacatagggctgcaaaaca

SEQ ID NO: 322 - DNA, 47 bp, Homo sapiens
  allele (1)..(47): polymorphic fragment 99-148-139, variant version of SEQ ID 245
  allele (24)..(24): polymorphic base T; C in SEQ ID 245
  primer_bind (1)..(23): potential microsequencing oligo 99-148-139.mis1
  primer_bind (25)..(47): complement potential microsequencing oligo 99-148-139.mis2
tacaaataattttgaatttaatatatagggctgcaaaacaaggttga

SEQ ID NO: 323 - DNA, 47 bp, Homo sapiens
  allele (1)..(47): polymorphic fragment 99-148-140, variant version of SEQ ID 246
  allele (24)..(24): polymorphic base G; A in SEQ ID 246
  primer_bind (1)..(23): potential microsequencing oligo 99-148-140.mis1
  primer_bind (25)..(47): complement potential microsequencing oligo 99-148-140.mis2
acaaataattttgaatttaatacgtagggctgcaaaacaaggttgat

SEQ ID NO: 324 - DNA, 47 bp, Homo sapiens
  allele (1)..(47): polymorphic fragment 99-148-182, variant version of SEQ ID 247
  allele (24)..(24): polymorphic base G; A in SEQ ID 247
  primer_bind (1)..(23): potential microsequencing oligo 99-148-182.mis1
  primer_bind (25)..(47): complement potential microsequencing oligo 99-148-182.mis2
ttgatgttgatatgggcaactgtgtgttggatggtcccaaagcattc

SEQ ID NO: 325 - DNA, 47 bp, Homo sapiens
  allele (1)..(47): polymorphic fragment 99-148-366, variant version of SEQ ID 248
  allele (24)..(24): polymorphic base T; G in SEQ ID 248
  primer_bind (1)..(23): potential microsequencing oligo 99-148-366.mis1
  primer_bind (25)..(47): complement potential microsequencing oligo 99-148-366.mis2
tccttgtcaaaggtctctccctgttgctcacggctgccgcctcaaag

SEQ ID NO: 326 - DNA, 47 bp, Homo sapiens
  allele (1)..(47): polymorphic fragment 99-148-76, variant version of SEQ ID 249
  allele (24)..(24): polymorphic base T; C in SEQ ID 249
  primer_bind (1)..(23): potential microsequencing oligo 99-148-76.mis1
  primer_bind (25)..(47): complement potential microsequencing oligo 99-148-76.mis2
tgatagaatgccttcctgaattattactcttgatggcttcataaaac

SEQ ID NO: 327 - DNA, 47 bp, Homo sapiens
  allele (1)..(47): polymorphic fragment 99-1480-290, variant version of SEQ ID 250
  allele (24)..(24): polymorphic base T; G in SEQ ID 250
  primer_bind (1)..(23): potential microsequencing oligo 99-1480-290.mis1
  primer_bind (25)..(47): complement potential microsequencing oligo 99-1480-290.mis2
tgcaccatcttcaccacaacccctggcaaccactgatccttttactg

SEQ ID NO: 328 - DNA, 47 bp, Homo sapiens
  allele (1)..(47): polymorphic fragment 99-1481-285, variant version of SEQ ID 251
  allele (24)..(24): polymorphic base T; G in SEQ ID 251
  primer_bind (1)..(23): potential microsequencing oligo 99-1481-285.mis1
  primer_bind (25)..(47): complement potential microsequencing oligo 99-1481-285.mis2
tcccataacctgttttgcttctctctctaacctcaagatggtataaa

SEQ ID NO: 329 - DNA, 47 bp, Homo sapiens
  allele (1)..(47): polymorphic fragment 99-1484-101, variant version of SEQ ID 252
  allele (24)..(24): polymorphic base C; A in SEQ ID 252
  primer_bind (1)..(23): potential microsequencing oligo 99-1484-101.mis1
  primer_bind (25)..(47): complement potential microsequencing oligo 99-1484-101.mis2
aaaaagatcaaatataagcatgtcactcctctccttaaaatctcagt

SEQ ID NO: 330 - DNA, 47 bp, Homo sapiens
  allele (1)..(47): polymorphic fragment 99-1484-328, variant version of SEQ ID 253
  allele (24)..(24): polymorphic base C; G in SEQ ID 253
  primer_bind (1)..(23): potential microsequencing oligo 99-1484-328.mis1
  primer_bind (25)..(47): complement potential microsequencing oligo 99-1484-328.mis2
ggacacgtggtcatgaggagtttcaagggattcagttttcagatccc

SEQ ID NO: 331 - DNA, 47 bp, Homo sapiens
  allele (1)..(47): polymorphic fragment 99-1485-251, variant version of SEQ ID 254
  allele (24)..(24): polymorphic base T; G in SEQ ID 254
  primer_bind (1)..(23): potential microsequencing oligo 99-1485-251.mis1
  primer_bind (25)..(47): complement potential microsequencing oligo 99-1485-251.mis2
gattgccttgatatatgctcccatagaaccaagaatgtccccttttc

SEQ ID NO: 332 - DNA, 47 bp, Homo sapiens
  allele (1)..(47): polymorphic fragment 99-1490-381, variant version of SEQ ID 255
  allele (24)..(24): polymorphic base T; C in SEQ ID 255
  primer_bind (1)..(23): potential microsequencing oligo 99-1490-381.mis1
  primer_bind (25)..(47): complement potential microsequencing oligo 99-1490-381.mis2
tgcacagtggaaataccatgtcatggtacgctactgtgcatctcttc

SEQ ID NO: 333 - DNA, 47 bp, Homo sapiens
  allele (1)..(47): polymorphic fragment 99-1493-280, variant version of SEQ ID 256
  allele (24)..(24): polymorphic base G; A in SEQ ID 256
  primer_bind (1)..(23): potential microsequencing oligo 99-1493-280.mis1
  primer_bind (25)..(47): complement potential microsequencing oligo 99-1493-280.mis2
ggatgacagagtattgttggagggatggggtttggctgcttgttttt

SEQ ID NO: 334 - DNA, 47 bp, Homo sapiens
  allele (1)..(47): polymorphic fragment 99-151-94, variant version of SEQ ID 257
  allele (24)..(24): polymorphic base G; A in SEQ ID 257
  primer_bind (1)..(23): potential microsequencing oligo 99-151-94.mis1
  primer_bind (25)..(47): complement potential microsequencing oligo 99-151-94.mis2
attgagatcattgataaggaaatgttctaaaatttcaaaatctatat

SEQ ID NO: 335 - DNA, 47 bp, Homo sapiens
  allele (1)..(47): polymorphic fragment 99-211-291, variant version of SEQ ID 258
  allele (24)..(24): polymorphic base G; A in SEQ ID 258
  primer_bind (1)..(23): potential microsequencing oligo 99-211-291.mis1
  primer_bind (25)..(47): complement potential microsequencing oligo 99-211-291.mis2
ctggttatatcagactgaccttcgtgttttcaacaggtcaatgcctt

SEQ ID NO: 336 - DNA, 46 bp, Homo sapiens
  allele (1)..(46): polymorphic fragment 99-213-37, variant version of SEQ ID 259
  allele (23)..(23): polymorphic base GC, T in SEQ ID 259
  primer_bind (1)..(22): potential microsequencing oligo 99-213-37.mis1
  primer_bind (24)..(46): complement potential microsequencing oligo 99-213-37.mis2
gtgcttccggctgcaggactgtgcggaggactccagtgtctgacag

SEQ ID NO: 337 - DNA, 47 bp, Homo sapiens
  allele (1)..(47): polymorphic fragment 99-221-442, variant version of SEQ ID 260
  allele (24)..(24): polymorphic base C; A in SEQ ID 260
  primer_bind (1)..(23): potential microsequencing oligo 99-221-442.mis1
  primer_bind (25)..(47): complement potential microsequencing oligo 99-221-442.mis2
tgcctttgtagatatgcatgggacttccatgacctagccagacgaat

SEQ ID NO: 338 - DNA, 47 bp, Homo sapiens
  allele (1)..(47): polymorphic fragment 99-222-109, variant version of SEQ ID 261
  allele (24)..(24): polymorphic base T; C in SEQ ID 261
  primer_bind (1)..(23): potential microsequencing oligo 99-222-109.mis1
  primer_bind (25)..(47): complement potential microsequencing oligo 99-222-109.mis2
caggtgaggagtgctggattggctacgatatgaatttcttcagcagt

SEQ ID NO: 339 - DNA, 18 bp, Homo sapiens
  misc_feature (1)..(18): upstream amplification primer for SEQ 185, SEQ 262, SEQ 186, SEQ 263, SEQ 187, SEQ 264
tctaacctctcatccaac

SEQ ID NO: 340 - DNA, 19 bp, Homo sapiens
  misc_feature (1)..(19): upstream amplification primer for SEQ 188, SEQ 265, SEQ 189, SEQ 266
gttatcgtgagactttttc

SEQ ID NO: 341 - DNA, 18 bp, Homo sapiens
  misc_feature (1)..(18): upstream amplification primer for SEQ 190, SEQ 267, SEQ 191, SEQ 268
tgctggtgctgtgataac

SEQ ID NO: 342 - DNA, 18 bp, Homo sapiens
  misc_feature (1)..(18): upstream amplification primer for SEQ 192, SEQ 269, SEQ 193, SEQ 270
tacagccctgtaagacac

SEQ ID NO: 343 - DNA, 19 bp, Homo sapiens
  misc_feature (1)..(19): upstream amplification primer for SEQ 194, SEQ 271
cagtatgttcaatgcacag

SEQ ID NO: 344 - DNA, 18 bp, Homo sapiens
  misc_feature (1)..(18): upstream amplification primer for SEQ 195, SEQ 272, SEQ 196, SEQ 273
aaaacatcgacatgggac

SEQ ID NO: 345 - DNA, 18 bp, Homo sapiens
  misc_feature (1)..(18): upstream amplification primer for SEQ 197, SEQ 274, SEQ 198, SEQ 275, SEQ 199, SEQ 276
agcatttcgagtcatgtg

SEQ ID NO: 346 - DNA, 18 bp, Homo sapiens
  misc_feature (1)..(18): upstream amplification primer for SEQ 200, SEQ 277, SEQ 201, SEQ 278
ccctctttcctcatgtag

SEQ ID NO: 347 - DNA, 19 bp, Homo sapiens
  misc_feature (1)..(19): upstream amplification primer for SEQ 202, SEQ 279, SEQ 203, SEQ 280
taactcgtaaacagagaac

SEQ ID NO: 348 - DNA, 18 bp, Homo sapiens
  misc_feature (1)..(18): upstream amplification primer for SEQ 204, SEQ 281, SEQ 205, SEQ 282, SEQ 206, SEQ 283, SEQ 207, SEQ 284, SEQ 208, SEQ 285
gcgtattgaagctctttg

SEQ ID NO: 349 - DNA, 18 bp, Homo sapiens
  misc_feature (1)..(18): upstream amplification primer for SEQ 209, SEQ 286, SEQ 210, SEQ 287
aacacggggattttaggc

SEQ ID NO: 350 - DNA, 19 bp, Homo sapiens
  misc_feature (1)..(19): upstream amplification primer for SEQ 211, SEQ 288
cacatactaaggctaatgg

SEQ ID NO: 351 - DNA, 18 bp, Homo sapiens
  misc_feature (1)..(18): upstream amplification primer for SEQ 212, SEQ 289, SEQ 213, SEQ 290
gttgctggaacctatttg

SEQ ID NO: 352 - DNA, 18 bp, Homo sapiens
  misc_feature (1)..(18): upstream amplification primer for SEQ 214, SEQ 291, SEQ 215, SEQ 292
tcgatggcttaatctacc

SEQ ID NO: 353 - DNA, 18 bp, Homo sapiens
  misc_feature (1)..(18): upstream amplification primer for SEQ 216, SEQ 293, SEQ 217, SEQ 294
aaagaggagtaaatgggg

SEQ ID NO: 354 - DNA, 18 bp, Homo sapiens
  misc_feature (1)..(18): upstream amplification primer for SEQ 218, SEQ 295, SEQ 219, SEQ 296
tccccacagctaagagcc

SEQ ID NO: 355 - DNA, 18 bp, Homo sapiens
  misc_feature (1)..(18): upstream amplification primer for SEQ 220, SEQ 297, SEQ 221, SEQ 298
atacctaatttcaggggg

SEQ ID NO: 356 - DNA, 19 bp, Homo sapiens
  misc_feature (1)..(19): upstream amplification primer for SEQ 222, SEQ 299, SEQ 223, SEQ 300
ttaacagagtaccttggag

SEQ ID NO: 357 - DNA, 18 bp, Homo sapiens
  misc_feature (1)..(18): upstream amplification primer for SEQ 224, SEQ 301, SEQ 225, SEQ 302
gtacagccttttgcttac

SEQ ID NO: 358 - DNA, 18 bp, Homo sapiens
  misc_feature (1)..(18): upstream amplification primer for SEQ 226, SEQ 303
aacgtgtcatagaaagcc

SEQ ID NO: 359 - DNA, 19 bp, Homo sapiens
  misc_feature (1)..(19): upstream amplification primer for SEQ 227, SEQ 304
gctgatgagttagataacc

SEQ ID NO: 360 - DNA, 18 bp, Homo sapiens
  misc_feature (1)..(18): upstream amplification primer for SEQ 228, SEQ 305
aaagccaggactagaagg

SEQ ID NO: 361 - DNA, 18 bp, Homo sapiens
  misc_feature (1)..(18): upstream amplification primer for SEQ 229, SEQ 306, SEQ 230, SEQ 307, SEQ 231, SEQ 308, SEQ 232, SEQ 309
gaccagggtttaagttag

SEQ ID NO: 362 - DNA, 18 bp, Homo sapiens
  misc_feature (1)..(18): upstream amplification primer for SEQ 233, SEQ 310
tctgttaggacctgtgag

SEQ ID NO: 363 - DNA, 19 bp, Homo sapiens
  misc_feature (1)..(19): upstream amplification primer for SEQ 234, SEQ 311
ccataacagctagtacaac

SEQ ID NO: 364 - DNA, 18 bp, Homo sapiens
  misc_feature (1)..(18): upstream amplification primer for SEQ 235, SEQ 312
tggaaaggtactcagaag

SEQ ID NO: 365 - DNA, 19 bp, Homo sapiens
  misc_feature (1)..(19): upstream amplification primer for SEQ 236, SEQ 313
agagcatagtataaagcag

SEQ ID NO: 366 - DNA, 19 bp, Homo sapiens
  misc_feature (1)..(19): upstream amplification primer for SEQ 237, SEQ 314
ctagaagtagctttaacag

SEQ ID NO: 367 - DNA, 19 bp, Homo sapiens
  misc_feature (1)..(19): upstream amplification primer for SEQ 238, SEQ 315
gcagccaatcttatatttc

SEQ ID NO: 368 - DNA, 19 bp, Homo sapiens
  misc_feature (1)..(19): upstream amplification primer for SEQ 239, SEQ 316, SEQ 240, SEQ 317
aaggttgtagagtagaaag

SEQ ID NO: 369 - DNA, 18 bp, Homo sapiens
  misc_feature (1)..(18): upstream amplification primer for SEQ 241, SEQ 318, SEQ 242, SEQ 319
caactgacactataaccc

SEQ ID NO: 370 - DNA, 18 bp, Homo sapiens
  misc_feature (1)..(18): upstream amplification primer for SEQ 243, SEQ 320, SEQ 244, SEQ 321, SEQ 245, SEQ 322, SEQ 246, SEQ 323, SEQ 247, SEQ 324, SEQ 248, SEQ 325, SEQ 249, SEQ 326
cagtggagtgtttatgtg

SEQ ID NO: 371 - DNA, 19 bp, Homo sapiens
  misc_feature (1)..(19): upstream amplification primer for SEQ 250, SEQ 327
ttgcacaaaaggtatagag

SEQ ID NO: 372 - DNA, 19 bp, Homo sapiens
  misc_feature (1)..(19): upstream amplification primer for SEQ 251, SEQ 328
aggctccccttttgagttg

SEQ ID NO: 373 - DNA, 18 bp, Homo sapiens
  misc_feature (1)..(18): upstream amplification primer for SEQ 252, SEQ 329, SEQ 253, SEQ 330
atcctttctagctgggag

SEQ ID NO: 374 - DNA, 20 bp, Homo sapiens
  misc_feature (1)..(20): upstream amplification primer for SEQ 254, SEQ 331
gtttaagaatgtgtgatggg

SEQ ID NO: 375 - DNA, 19 bp, Homo sapiens
  misc_feature (1)..(19): upstream amplification primer for SEQ 255, SEQ 332
aaggcaacagcgttgtgac

SEQ ID NO: 376 - DNA, 18 bp, Homo sapiens
  misc_feature (1)..(18): upstream amplification primer for SEQ 256, SEQ 333
ttttgggggttttcagtg

SEQ ID NO: 377 - DNA, 18 bp, Homo sapiens
  misc_feature (1)..(18): upstream amplification primer for SEQ 257, SEQ 334
aacacaacagcaaatccc

SEQ ID NO: 378 - DNA, 18 bp, Homo sapiens
  misc_feature (1)..(18): upstream amplification primer for SEQ 258, SEQ 335
tccttacttgtaaccccc

SEQ ID NO: 379 - DNA, 20 bp, Homo sapiens
  misc_feature (1)..(20): upstream amplification primer for SEQ 259, SEQ 336
atactggcagcgtgtgcttc

SEQ ID NO: 380 - DNA, 19 bp, Homo sapiens
  misc_feature (1)..(19): upstream amplification primer for SEQ 260, SEQ 337
ccctttttcttcactgttc

SEQ ID NO: 381 - DNA, 20 bp, Homo sapiens
  misc_feature (1)..(20): upstream amplification primer for SEQ 261, SEQ 338
aggggagatgagggaagttg

SEQ ID NO: 382 - DNA, 20 bp, Homo sapiens
  misc_feature (1)..(20): downstream amplification primer for SEQ 185, SEQ 262, SEQ 186, SEQ 263, SEQ 187, SEQ 264
gactgtatcctttgatgcac

SEQ ID NO: 383 - DNA, 20 bp, Homo sapiens
  misc_feature (1)..(20): downstream amplification primer for SEQ 188, SEQ 265, SEQ 189, SEQ 266
gcataattgtgcttgactgg

SEQ ID NO: 384 - DNA, 18 bp, Homo sapiens
  misc_feature (1)..(18): downstream amplification primer for SEQ 190, SEQ 267, SEQ 191, SEQ 268
tgctgagaggagcttttg

SEQ ID NO: 385 - DNA, 18 bp, Homo sapiens
  misc_feature (1)..(18): downstream amplification primer for SEQ 192, SEQ 269, SEQ 193, SEQ 270
tgaggactgctaggaaag

SEQ ID NO: 386 - DNA, 20 bp, Homo sapiens
  misc_feature (1)..(20): downstream amplification primer for SEQ 194, SEQ 271
acaaaatcaggaacaatggg

SEQ ID NO: 387 - DNA, 18 bp, Homo sapiens
  misc_feature (1)..(18): downstream amplification primer for SEQ 195, SEQ 272, SEQ 196, SEQ 273
ttgcattttccccccaac

SEQ ID NO: 388 - DNA, 18 bp, Homo sapiens
  misc_feature (1)..(18): downstream amplification primer for SEQ 197, SEQ 274, SEQ 198, SEQ 275, SEQ 199, SEQ 276
accatttggacaatgggg

SEQ ID NO: 389 - DNA, 20 bp, Homo sapiens
  misc_feature (1)..(20): downstream amplification primer for SEQ 200, SEQ 277, SEQ 201, SEQ 278
gctcttaaactggctctgtg

SEQ ID NO: 390 - DNA, 18 bp, Homo sapiens
  misc_feature (1)..(18): downstream amplification primer for SEQ 202, SEQ 279, SEQ 203, SEQ 280
ggcatgacttcacgtttc

SEQ ID NO: 391 - DNA, 18 bp, Homo sapiens
  misc_feature (1)..(18): downstream amplification primer for SEQ 204, SEQ 281, SEQ 205, SEQ 282, SEQ 206, SEQ 283, SEQ 207, SEQ 284, SEQ 208, SEQ 285
aggatcttctacagtcac

SEQ ID NO: 392 - DNA, 20 bp, Homo sapiens
  misc_feature (1)..(20): downstream amplification primer for SEQ 209, SEQ 286, SEQ 210, SEQ 287
tggtagcgtttgaaatcatc

SEQ ID NO: 393 - DNA, 20 bp, Homo sapiens
  misc_feature (1)..(20): downstream amplification primer for SEQ 211, SEQ 288
tataagcacaaataggttcc

SEQ ID NO: 394 - DNA, 18 bp, Homo sapiens
  misc_feature (1)..(18): downstream amplification primer for SEQ 212, SEQ 289, SEQ 213, SEQ 290
gaataactgaggggagtg

SEQ ID NO: 395 - DNA, 19 bp, Homo sapiens
  misc_feature (1)..(19): downstream amplification primer for SEQ 214, SEQ 291, SEQ 215, SEQ 292
gtgaatctccttttccaag

SEQ ID NO: 396 - DNA, 18 bp, Homo sapiens
  misc_feature (1)..(18): downstream amplification primer for SEQ 216, SEQ 293, SEQ 217, SEQ 294
ctaaggtgttgtagacag

SEQ ID NO: 397 - DNA, 20 bp, Homo sapiens
  misc_feature (1)..(20): downstream amplification primer for SEQ 218, SEQ 295, SEQ 219, SEQ 296
cacctcgataaatcaagtcc

SEQ ID NO: 398 - DNA, 20 bp, Homo sapiens
  misc_feature (1)..(20): downstream amplification primer for SEQ 220, SEQ 297, SEQ 221, SEQ 298
gttcacttaattctgttgag

SEQ ID NO: 399 - DNA, 18 bp, Homo sapiens
  misc_feature (1)..(18): downstream amplification primer for SEQ 222, SEQ 299, SEQ 223, SEQ 300
cgccttttctgaaaggtg

SEQ ID NO: 400 - DNA, 18 bp, Homo sapiens
  misc_feature (1)..(18): downstream amplification primer for SEQ 224, SEQ 301, SEQ 225, SEQ 302
attttctgcacagcagcg

SEQ ID NO: 401 - DNA, 19 bp, Homo sapiens
  misc_feature (1)..(19): downstream amplification primer for SEQ 226, SEQ 303
tattttctagctcttctgg

SEQ ID NO: 402 - DNA, 19 bp, Homo sapiens
  misc_feature (1)..(19): downstream amplification primer for SEQ 227, SEQ 304
agcaagagtgattgtaaag

SEQ ID NO: 403 - DNA, 18 bp, Homo sapiens
  misc_feature (1)..(18): downstream amplification primer for SEQ 228, SEQ 305
tattcagaaaggagtggg

SEQ ID NO: 404 - DNA, 18 bp, Homo sapiens
  misc_feature (1)..(18): downstream amplification primer for SEQ 229, SEQ 306, SEQ 230, SEQ 307, SEQ 231, SEQ 308, SEQ 232, SEQ 309
agagcgttcttgcctttc

SEQ ID NO: 405 - DNA, 20 bp, Homo sapiens
  misc_feature (1)..(20): downstream amplification primer for SEQ 233, SEQ 310
ggtaaccctaaaatgttatc

SEQ ID NO: 406 - DNA, 21 bp, Homo sapiens
  misc_feature (1)..(21): downstream amplification primer for SEQ 234, SEQ 311
agaaaccataagggtatattg

SEQ ID NO: 407 - DNA, 19 bp, Homo sapiens
  misc_feature (1)..(19): downstream amplification primer for SEQ 235, SEQ 312
acagtgcaaaggttatatc

SEQ ID NO: 408 - DNA, 21 bp, Homo sapiens
  misc_feature (1)..(21): downstream amplification primer for SEQ 236, SEQ 313
gaacaaccttgaattagcttg

SEQ ID NO: 409 - DNA, 21 bp, Homo sapiens
  misc_feature (1)..(21): downstream amplification primer for SEQ 237, SEQ 314
gattccagaagtccatttcag

SEQ ID NO: 410 - DNA, 21 bp, Homo sapiens
  misc_feature (1)..(21): downstream amplification primer for SEQ 238, SEQ 315
aggtaagaatgagcaaaaagg

SEQ ID NO: 411 - DNA, 19 bp, Homo sapiens
  misc_feature (1)..(19): downstream amplification primer for SEQ 239, SEQ 316, SEQ 240, SEQ 317
gcttgtgtttgttcaattc

SEQ ID NO: 412 - DNA, 18 bp, Homo sapiens
  misc_feature (1)..(18): downstream amplification primer for SEQ 241, SEQ 318, SEQ 242, SEQ 319
cttgaaatactcccagcc

SEQ ID NO: 413 - DNA, 19 bp, Homo sapiens
  misc_feature (1)..(19): downstream amplification primer for SEQ 243, SEQ 320, SEQ 244, SEQ 321, SEQ 245, SEQ 322, SEQ 246, SEQ 323, SEQ 247, SEQ 324, SEQ 248, SEQ 325, SEQ 249, SEQ 326
ccatgaactgagaactttg

SEQ ID NO: 414 - DNA, 18 bp, Homo sapiens
  misc_feature (1)..(18): downstream amplification primer for SEQ 250, SEQ 327
ggtgacaggtaaagaaac

SEQ ID NO: 415 - DNA, 21 bp, Homo sapiens
  misc_feature (1)..(21): downstream amplification primer for SEQ 251, SEQ 328
attcaggcacagaagtcatac

SEQ ID NO: 416 - DNA, 21 bp, Homo sapiens
  misc_feature (1)..(21): downstream amplification primer for SEQ 252, SEQ 329, SEQ 253, SEQ 330
agggcagcacaatgtagtaag

SEQ ID NO: 417 - DNA, 18 bp, Homo sapiens
  misc_feature (1)..(18): downstream amplification primer for SEQ 254, SEQ 331
cctctttatctccaaacc

SEQ ID NO: 418 - DNA, 19 bp, Homo sapiens
  misc_feature (1)..(19): downstream amplification primer for SEQ 255, SEQ 332
gaaaacaatcaagctctgg

SEQ ID NO: 419 - DNA, 19 bp, Homo sapiens
  misc_feature (1)..(19): downstream amplification primer for SEQ 256, SEQ 333
cctttatatccttggagtc

SEQ ID NO: 420 - DNA, 21 bp, Homo sapiens
  misc_feature (1)..(21): downstream amplification primer for SEQ 257, SEQ 334
tattacacgttccaactcttc

SEQ ID NO: 421 - DNA, 20 bp, Homo sapiens
  misc_feature (1)..(20): downstream amplification primer for SEQ 258, SEQ 335
ctgtgtttaagtgactgctg

SEQ ID NO: 422 - DNA, 21 bp, Homo sapiens
  misc_feature (1)..(21): downstream amplification primer for SEQ 259, SEQ 336
ttattgccccacatgcttgag

SEQ ID NO: 423 - DNA, 19 bp, Homo sapiens
  misc_feature (1)..(19): downstream amplification primer for SEQ 260, SEQ 337
tcattcgtctggctaggtc

SEQ ID NO: 424 - DNA, 21 bp, Homo sapiens
  misc_feature (1)..(21): downstream amplification primer for SEQ 261, SEQ 338
gaaacagactgaagcaaggac

SEQ ID NO: 425 - DNA, 19 bp, Homo sapiens
  misc_feature (1)..(19): potential microsequencing oligo for 4-14-107.mis1
acaaccaccaaatgcatac

SEQ ID NO: 426 - DNA, 19 bp, Homo sapiens
  misc_feature (1)..(19): potential microsequencing oligo for 4-14-317.mis1
acatgcaaggtgggcaaga

SEQ ID NO: 427 - DNA, 19 bp, Homo sapiens
  misc_feature (1)..(19): potential microsequencing oligo for 4-14-35.mis1
aacacagaaaccgctaaaa

SEQ ID NO: 428 - DNA, 23 bp, Homo sapiens
  misc_feature (1)..(23): microsequencing oligo for 4-20-149.mis1
tttttgctgtgtcttcaaagtga

SEQ ID NO: 429 - DNA, 19 bp, Homo sapiens
  misc_feature (1)..(19): potential microsequencing oligo for 4-20-77.mis1
acatgaagattctgaaggg

SEQ ID NO: 430 - DNA, 23 bp, Homo sapiens
  misc_feature (1)..(23): microsequencing oligo for 4-22-174.mis1
ggattgtgcagaagttgcctttc

SEQ ID NO: 431 - DNA, 19 bp, Homo sapiens
  misc_feature (1)..(19): potential microsequencing oligo for 4-22-176.mis1
tgcagaagttgcctttcat

SEQ ID NO: 432 - DNA, 19 bp, Homo sapiens
  misc_feature (1)..(19): potential microsequencing oligo for 4-26-60.mis1
ggaaagtgcatcttaagac

SEQ ID NO: 433 - DNA, 19 bp, Homo sapiens
  misc_feature (1)..(19): potential microsequencing oligo for 4-26-72.mis1
ttaagacagttagcaggcc

SEQ ID NO: 434 - DNA, 19 bp, Homo sapiens
  misc_feature (1)..(19): potential microsequencing oligo for 4-3-130.mis1
gggcctaaaacagtattct

SEQ ID NO: 435 - DNA, 19 bp, Homo sapiens
  misc_feature (1)..(19): potential microsequencing oligo for 4-38-63.mis1
agttataagaaaatcaggc

SEQ ID NO: 436 - DNA, 19 bp, Homo sapiens
  misc_feature (1)..(19): potential microsequencing oligo for 4-38-83.mis1
gaggctaaacttttttttt

SEQ ID NO: 437 - DNA, 19 bp, Homo sapiens
  misc_feature (1)..(19): potential microsequencing oligo for 4-4-152.mis1
ttcccattgttcctgactt

SEQ ID NO: 438 - DNA, 23 bp, Homo sapiens
  misc_feature (1)..(23): microsequencing oligo for 4-4-187.mis1
tataaacagaaacatggatgagt

SEQ ID NO: 439 - DNA, 19 bp, Homo sapiens
  misc_feature (1)..(19): potential microsequencing oligo for 4-4-288.mis1
catcaactaattttcacaa

SEQ ID NO: 440 - DNA, 19 bp, Homo sapiens
  misc_feature (1)..(19): potential microsequencing oligo for 4-42-304.mis1
tttaaaactatttatgtaa

SEQ ID NO: 441 - DNA, 23 bp, Homo sapiens
  misc_feature (1)..(23): microsequencing oligo for 4-42-401.mis1
taagaaagaattctgtgttctgg

SEQ ID NO: 442 - DNA, 19 bp, Homo sapiens
  misc_feature (1)..(19): potential microsequencing oligo for 4-43-328.mis1
ttctgtgttctggccaaag

SEQ ID NO: 443 - DNA, 23 bp, Homo sapiens
  misc_feature (1)..(23): microsequencing oligo for 4-43-70.mis1
atcgcctccattattctcaaaaa

SEQ ID NO: 444 - DNA, 23 bp, Homo sapiens
  misc_feature (1)..(23): microsequencing oligo for 4-50-209.mis1
atatagagtgtgcatccctgaca

SEQ ID NO: 445 - DNA, 23 bp, Homo sapiens
  misc_feature (1)..(23): microsequencing oligo for 4-50-293.mis1
cctgagtcccagggggctgacag

SEQ ID NO: 446 - DNA, 23 bp, Homo sapiens
  misc_feature (1)..(23): microsequencing oligo for 4-50-323.mis1
tttaaaacattgatgaatcttta

SEQ ID NO: 447 - DNA, 23 bp, Homo sapiens
  misc_feature (1)..(23): microsequencing oligo for 4-50-329.mis1
acattgatgaatctttattacta

SEQ ID NO: 448 - DNA, 19 bp, Homo sapiens
  misc_feature (1)..(19): potential microsequencing oligo for 4-50-330.mis1
gatgaatctttattactac

SEQ ID NO: 449 - DNA, 23 bp, Homo sapiens
  misc_feature (1)..(23): microsequencing oligo for 4-52-163.mis1
gaacaggatattcttaactacca

SEQ ID NO: 450 - DNA, 23 bp, Homo sapiens
  misc_feature (1)..(23): microsequencing oligo for 4-52-88.mis1
tccatgtcattattattcaaaag

SEQ ID NO: 451 - DNA, 19 bp, Homo sapiens
  misc_feature (1)..(19): potential microsequencing oligo for 4-53-258.mis1
aatcatgcagagagaatgc

SEQ ID NO: 452 - DNA, 23 bp, Homo sapiens
  misc_feature (1)..(23): microsequencing oligo for 4-54-283.mis1
aagtagtttttcacactttctct

SEQ ID NO: 453 - DNA, 19 bp, Homo sapiens
  misc_feature (1)..(19): potential microsequencing oligo for 4-54-388.mis1
ctatcgtatacatctttac

SEQ ID NO: 454 - DNA, 19 bp, Homo sapiens
  misc_feature (1)..(19): potential microsequencing oligo for 4-55-70.mis1
aagaacctaggttttaaaa

SEQ ID NO: 455 - DNA, 23 bp, Homo sapiens
  misc_feature (1)..(23): microsequencing oligo for 4-55-95.mis1
ctctctatcgtatacatctttac

SEQ ID NO: 456 - DNA, 23 bp, Homo sapiens
  misc_feature (1)..(23): microsequencing oligo for 4-56-159.mis1
aagttttccttctcttctgtaga

SEQ ID NO: 457 - DNA, 19 bp, Homo sapiens
  misc_feature (1)..(19): potential microsequencing oligo for 4-56-213.mis1
ctcatgttcactctggttc

SEQ ID NO: 458 - DNA, 23 bp, Homo sapiens
  misc_feature (1)..(23): microsequencing oligo for 4-58-289.mis1
catacctgcagcctgcttttggt

SEQ ID NO: 459 - DNA, 23 bp, Homo sapiens
  misc_feature (1)..(23): microsequencing oligo for 4-58-318.mis1
tgactactttacctgcaatattt

SEQ ID NO: 460 - DNA, 23 bp, Homo sapiens
  misc_feature (1)..(23): microsequencing oligo for 4-60-266.mis1
aacaggaccaagacactgcatta

SEQ ID NO: 461 - DNA, 23 bp, Homo sapiens
  misc_feature (1)..(23): microsequencing oligo for 4-60-293.mis1
aagtttcagtatttcttagcaga

SEQ ID NO: 462 - DNA, 19 bp, Homo sapiens
  misc_feature (1)..(19): potential microsequencing oligo for 4-84-241.mis1
aaaaaatagtgactgccac

SEQ ID NO: 463 - DNA, 19 bp, Homo sapiens
  misc_feature (1)..(19): potential microsequencing oligo for 4-84-262.mis1
tgaataattcagttcttca

SEQ ID NO: 464 - DNA, 19 bp, Homo sapiens
  misc_feature (1)..(19): potential microsequencing oligo for 4-86-206.mis1
tcaaatcaggacacaccac

SEQ ID NO: 465 - DNA, 19 bp, Homo sapiens
  misc_feature (1)..(19): potential microsequencing oligo for 4-86-309.mis1
tctaggcaggccactttag

SEQ ID NO: 466 - DNA, 19 bp, Homo sapiens
  misc_feature (1)..(19): potential microsequencing oligo for 4-88-349.mis1
ctaaaagacaatattcagt

SEQ ID NO: 467 - DNA, 23 bp, Homo sapiens
  misc_feature (1)..(23): microsequencing oligo for 4-89-87.mis1
ttcttccctgaacgctggtttca

SEQ ID NO: 468 - DNA, 19 bp, Homo sapiens
  misc_feature (1)..(19): potential microsequencing oligo for 99-123-184.mis1
cccagaacattcaccagct

SEQ ID NO: 469 - DNA, 19 bp, Homo sapiens
  misc_feature (1)..(19): potential microsequencing oligo for 99-128-202.mis1
tctgtttcttagagaactg

SEQ ID NO: 470 - DNA, 19 bp, Homo sapiens
  misc_feature (1)..(19): potential microsequencing oligo for 99-128-275.mis1
ccctacctcacatgtgtag

SEQ ID NO: 471 - DNA, 19 bp, Homo sapiens
  misc_feature (1)..(19): potential microsequencing oligo for 99-128-313.mis1
tctctagacagatatacat

SEQ ID NO: 472 - DNA, 23 bp, Homo sapiens
  misc_feature (1)..(23): microsequencing oligo for 99-128-60.mis1
cactgtgacccaggcgctagcgt

SEQ ID NO: 473 - DNA, 19 bp, Homo sapiens
  misc_feature (1)..(19): potential microsequencing oligo for 99-12907-295.mis1
tatggcattatatctccac

SEQ ID NO: 474 - DNA, 19 bp, Homo sapiens
  misc_feature (1)..(19): microsequencing oligo for 99-130-58.mis1
caaaagagcttcaaaaata

SEQ ID NO: 475 - DNA, 19 bp, Homo sapiens
  misc_feature (1)..(19): potential microsequencing oligo for 99-134-362.mis1
acactcatgttagttagat

SEQ ID NO: 476 - DNA, 19 bp, Homo sapiens
  misc_feature (1)..(19): microsequencing oligo for 99-140-130.mis1
caaaagcagctacagacca

SEQ ID NO: 477 - DNA, 19 bp, Homo sapiens
  misc_feature (1)..(19): microsequencing oligo for 99-1462-238.mis1
ttcaaggttagtaactcat

SEQ ID NO: 478 - DNA, 19 bp, Homo sapiens
  misc_feature (1)..(19): potential microsequencing oligo for 99-147-181.mis1
catgaaaaagagcatgata

SEQ ID NO: 479 - DNA, 19 bp, Homo sapiens
  misc_feature (1)..(19): potential microsequencing oligo for 99-1474-156.mis1
tactcataagttaaatatt

SEQ ID NO: 480 - DNA, 19 bp, Homo sapiens
  misc_feature (1)..(19): potential microsequencing oligo for .3 99-1474-359.mis1
aaaatcaaattattgtacc

SEQ ID NO: 481 - DNA, 19 bp, Homo sapiens
  misc_feature (1)..(19): microsequencing oligo for 99-1479-158.mis1
aaaatccacttgtaatcgc

SEQ ID NO: 482 - DNA, 19 bp, Homo sapiens
  misc_feature (1)..(19): potential microsequencing oligo for 99-1479-379.mis1
agctgtgtactgaggtcag

SEQ ID NO: 483 - DNA, 19 bp, Homo sapiens
  misc_feature (1)..(19): potential microsequencing oligo for 99-148-129.mis1
tatctatacaaataatttt

SEQ ID NO: 484 - DNA, 19 bp, Homo sapiens
  misc_feature (1)..(19): potential microsequencing oligo for 99-148-132.mis1
ctatacaaataattttgaa

SEQ ID NO: 485 - DNA, 19 bp, Homo sapiens
  misc_feature (1)..(19): potential microsequencing oligo for 99-148-139.mis1
aataattttgaatttaata

SEQ ID NO: 486 - DNA, 19 bp, Homo sapiens
  misc_feature (1)..(19): potential microsequencing oligo for 99-148-140.mis1
ataattttgaatttaatac

SEQ ID NO: 487 - DNA, 19 bp, Homo sapiens
  misc_feature (1)..(19): potential microsequencing oligo for 99-148-182.mis1
tgttgatatgggcaactgt

SEQ ID NO: 488 - DNA, 19 bp, Homo sapiens
  misc_feature (1)..(19): potential microsequencing oligo for 99-148-366.mis1
tgtcaaaggtctctccctg

SEQ ID NO: 489 - DNA, 19 bp, Homo sapiens
  misc_feature (1)..(19): potential microsequencing oligo for 99-148-76.mis1
agaatgccttcctgaatta

SEQ ID NO: 490 - DNA, 19 bp, Homo sapiens
  misc_feature (1)..(19): potential microsequencing oligo for 99-1480-290.mis1
ccatcttcaccacaacccc

SEQ ID NO: 491 - DNA, 19 bp, Homo sapiens
  misc_feature (1)..(19): potential microsequencing oligo for 99-1481-285.mis1
ataacctgttttgcttctc

SEQ ID NO: 492 - DNA, 19 bp, Homo sapiens
  misc_feature (1)..(19): potential microsequencing oligo for 99-1484-101.mis1
agatcaaatataagcatgt

SEQ ID NO: 493 - DNA, 19 bp, Homo sapiens
  misc_feature (1)..(19): microsequencing oligo for 99-1484-328.mis1
acgtggtcatgaggagttt

SEQ ID NO: 494 - DNA, 19 bp, Homo sapiens
  misc_feature (1)..(19): potential microsequencing oligo for 99-1485-251.mis1
gccttgatatatgctccca

SEQ ID NO: 495 - DNA, 19 bp, Homo sapiens
  misc_feature (1)..(19): microsequencing oligo for 99-1490-381.mis1
cagtggaaataccatgtca

SEQ ID NO: 496 - DNA, 19 bp, Homo sapiens
  misc_feature (1)..(19): potential microsequencing oligo for 99-1493-280.mis1
gacagagtattgttggagg

SEQ ID NO: 497 - DNA, 19 bp, Homo sapiens
  misc_feature (1)..(19): potential microsequencing oligo for 99-151-94.mis1
agatcattgataaggaaat

SEQ ID NO: 498 - DNA, 19 bp, Homo sapiens
  misc_feature (1)..(19): microsequencing oligo for 99-211-291.mis1
ttatatcagactgaccttc

SEQ ID NO: 499 - DNA, 19 bp, Homo sapiens
  misc_feature (1)..(19): potential microsequencing oligo for 99-213-37.mis1
cttccggctgcaggactgt

SEQ ID NO: 500 - DNA, 19 bp, Homo sapiens
  misc_feature (1)..(19): potential microsequencing oligo for 99-221-442.mis1
tttgtagatatgcatggga

SEQ ID NO: 501 - DNA, 23 bp, Homo sapiens
  misc_feature (1)..(23): microsequencing oligo for 99-222-109.mis1
caggtgaggagtgctggattggc

SEQ ID NO: 502 - DNA, 23 bp, Homo sapiens
  misc_feature (1)..(23): microsequencing oligo for 4-14-107.mis2
ctatcaggcatttgcctggttgc

SEQ ID NO: 503 - DNA, 23 bp, Homo sapiens
  misc_feature (1)..(23): microsequencing oligo for 4-14-317.mis2
tcatgacctgtgcccacctcttt

SEQ ID NO: 504 - DNA, 23 bp, Homo sapiens
  misc_feature (1)..(23): microsequencing oligo for 4-14-35.mis2
tctctgcagacagcttctgcctg

SEQ ID NO: 505 - DNA, 19 bp, Homo sapiens
  misc_feature (1)..(19): potential microsequencing oligo for 4-20-149.mis2
agcaggcaataaaccaaga

SEQ ID NO: 506 - DNA, 19 bp, Homo sapiens
  misc_feature (1)..(19): potential microsequencing oligo for 4-20-77.mis2
gtgttctcagacaacaaag

SEQ ID NO: 507 - DNA, 19 bp, Homo sapiens
  misc_feature (1)..(19): potential microsequencing oligo for 4-22-174.mis2
aaattaacatttttgaaca

SEQ ID NO: 508 - DNA, 19 bp, Homo sapiens
  misc_feature (1)..(19): potential microsequencing oligo for 4-22-176.mis2
acaaattaacatttttgaa

SEQ ID NO: 509 - DNA, 23 bp, Homo sapiens
  misc_feature (1)..(23): microsequencing oligo for 4-26-60.mis2
aagtcgctcctcggcctgctaac

SEQ ID NO: 510 - DNA, 19 bp, Homo sapiens
  misc_feature (1)..(19): potential microsequencing oligo for 4-26-72.mis2
accctttaaagtcgctcct

SEQ ID NO: 511 - DNA, 23 bp, Homo sapiens
  misc_feature (1)..(23): microsequencing oligo for 4-3-130.mis2
agttaataccaatttaagcttta

SEQ ID NO: 512 - DNA, 19 bp, Homo sapiens
  misc_feature (1)..(19): potential microsequencing oligo for 4-38-63.mis2
aaaaaaaaagtttagcctc

SEQ ID NO: 513 - DNA, 23 bp, Homo sapiens
  misc_feature (1)..(23): microsequencing oligo for 4-38-83.mis2
atattctcaacagcattgccaaa

SEQ ID NO: 514 - DNA, 19 bp, Homo sapiens
  misc_feature (1)..(19): potential microsequencing oligo for 4-4-152.mis2
tgtttatatataggataac

SEQ ID NO: 515 - DNA, 19 bp, Homo sapiens
  misc_feature (1)..(19): potential microsequencing oligo for 4-4-187.mis2
ttttttttttttttttttt

SEQ ID NO: 516 - DNA, 19 bp, Homo sapiens
  misc_feature (1)..(19): potential microsequencing oligo for 4-4-288.mis2
tgaaatcaaaacataggta

SEQ ID NO: 517 - DNA, 19 bp, Homo sapiens
  misc_feature (1)..(19): potential microsequencing oligo for 4-42-304.mis2
aaaaacccctgaaaataag

SEQ ID NO: 518 - DNA, 19 bp, Homo sapiens
  misc_feature (1)..(19): potential microsequencing oligo for 4-42-401.mis2
tctgtgggtttaaactttg

SEQ ID NO: 519 - DNA, 19 bp, Homo sapiens
  misc_feature (1)..(19): potential microsequencing oligo for 4-43-328.mis2
actggctctgtgggtttaa

SEQ ID NO: 520 - DNA, 19 bp, Homo sapiens
  misc_feature (1)..(19): potential microsequencing oligo for 4-43-70.mis2
ttgtgttgtgtcccatggt

SEQ ID NO: 521 - DNA, 19 bp, Homo sapiens
  misc_feature (1)..(19): potential microsequencing oligo for 4-50-209.mis2
cataaagccttcagtttca

SEQ ID NO: 522 - DNA, 19 bp, Homo sapiens
  misc_feature (1)..(19): potential microsequencing oligo for 4-50-293.mis2
tcaatgttttaaactgtcc

SEQ ID NO: 523 - DNA, 19 bp, Homo sapiens
  misc_feature (1)..(19): potential microsequencing oligo for 4-50-323.mis2
atcgaacccttttgtagta

SEQ ID NO: 524 - DNA, 19 bp, Homo sapiens
  misc_feature (1)..(19): potential microsequencing oligo for 4-50-329.mis2
gcctaaatcgaaccctttt

SEQ ID NO: 525 - DNA, 19 bp, Homo sapiens
  misc_feature (1)..(19): potential microsequencing oligo for 4-50-330.mis2
agcctaaatcgaacccttt

SEQ ID NO: 526 - DNA, 19 bp, Homo sapiens
  misc_feature (1)..(19): potential microsequencing oligo for 4-52-163.mis2
aatagatgtgtaaaattct

SEQ ID NO: 527 - DNA, 19 bp, Homo sapiens
  misc_feature (1)..(19): potential microsequencing oligo for 4-52-88.mis2
caccttgtgtattttttaa

SEQ ID NO: 528 - DNA, 23 bp, Homo sapiens
  misc_feature (1)..(23): microsequencing oligo for 4-53-258.mis2
ttaggttaaaatttgagtgagaa

SEQ ID NO: 529 - DNA, 19 bp, Homo sapiens
  misc_feature (1)..(19): potential microsequencing oligo for 4-54-283.mis2
taagccatcgattgtatca

SEQ ID NO: 530 - DNA, 19 bp, Homo sapiens
  misc_feature (1)..(19): potential microsequencing oligo for 4-54-388.mis2
gtcttggcgctgcagcgtg

SEQ ID NO: 531 - DNA, 23 bp, Homo sapiens
  misc_feature (1)..(23): microsequencing oligo for 4-55-70.mis2
taaagatgtatacgatagagagt

SEQ ID NO: 532 - DNA, 19 bp, Homo sapiens
  misc_feature (1)..(19): potential microsequencing oligo for 4-55-95.mis2
gtcttggcgctgcagcgtg

SEQ ID NO: 533 - DNA, 19 bp, Homo sapiens
  misc_feature (1)..(19): potential microsequencing oligo for 4-56-159.mis2
ttgactgtaacatggagac

SEQ ID NO: 534 - DNA, 19 bp, Homo sapiens
  misc_feature (1)..(19): potential microsequencing oligo for 4-56-213.mis2
tatcaaactcctctgaagg

SEQ ID NO: 535 - DNA, 19 bp, Homo sapiens
  misc_feature (1)..(19): potential microsequencing oligo for 4-58-289.mis2
aggtaaagtagtcacccct

SEQ ID NO: 536 - DNA, 19 bp, Homo sapiens
  misc_feature (1)..(19): potential microsequencing oligo for 4-58-318.mis2
gaagaaataaacttgcaaa

SEQ ID NO: 537 - DNA, 19 bp, Homo sapiens
  misc_feature (1)..(19): potential microsequencing oligo for 4-60-266.mis2
agaaatactgaaactttat

SEQ ID NO: 538 - DNA, 19 bp, Homo sapiens
  misc_feature (1)..(19): potential microsequencing oligo for 4-60-293.mis2
aggacttcctgctggcttc

SEQ ID NO: 539 - DNA, 23 bp, Homo sapiens
  misc_feature (1)..(23): microsequencing oligo for 4-84-241.mis2
ttctgaagaactgaattattcac

SEQ ID NO: 540 - DNA, 19 bp, Homo sapiens
  misc_feature (1)..(19): potential microsequencing oligo for 4-84-262.mis2
tgagatcatgttgctgctt

SEQ ID NO: 541 - DNA, 23 bp, Homo sapiens
  misc_feature (1)..(23): microsequencing oligo for 4-86-206.mis2
aatgttaacgtgtagatgccatt

SEQ ID NO: 542 - DNA, 19 bp, Homo sapiens
  misc_feature (1)..(19): potential microsequencing oligo for 4-86-309.mis2
gctctctggttcctcactc

SEQ ID NO: 543 - DNA, 19 bp, Homo sapiens
  misc_feature (1)..(19): potential microsequencing oligo for 4-88-349.mis2
aagaacttggaaaatctca

SEQ ID NO: 544 - DNA, 19 bp, Homo sapiens
  misc_feature (1)..(19): potential microsequencing oligo for 4-89-87.mis2
ttctcaacacaaaaactat

SEQ ID NO: 545 - DNA, 19 bp, Homo sapiens
  misc_feature (1)..(19): potential microsequencing oligo for 99-123-184.mis2
cccagcagaactcttggcc

SEQ ID NO: 546 - DNA, 19 bp, Homo sapiens
  misc_feature (1)..(19): potential microsequencing oligo for 99-128-202.mis2
gtatgtatgtgtgtgtgtt

SEQ ID NO: 547 - DNA, 19 bp, Homo sapiens
  misc_feature (1)..(19): potential microsequencing oligo for 99-128-275.mis2
acatatatgcatacatttg

SEQ ID NO: 548 - DNA, 19 bp, Homo sapiens
  misc_feature (1)..(19): potential microsequencing oligo for 99-128-313.mis2
tctatgccaaatagaatct

SEQ ID NO: 549 - DNA, 19 bp, Homo sapiens
  misc_feature (1)..(19): potential microsequencing oligo for 99-128-60.mis2
ggagtgtcactgtaagagg

SEQ ID NO: 550 - DNA, 19 bp, Homo sapiens
  misc_feature (1)..(19): microsequencing oligo for 99-12907-295.mis2
ttgtacatcaggtctgccc

SEQ ID NO: 551 - DNA, 23 bp, Homo sapiens
  misc_feature (1)..(23): microsequencing oligo for 99-130-58.mis2
ctcgccatatgcacactcctgaa

SEQ ID NO: 552 - DNA, 19 bp, Homo sapiens
  misc_feature (1)..(19): microsequencing oligo for 99-134-362.mis2
tctttgtaataggaataat

SEQ ID NO: 553 - DNA, 19 bp, Homo sapiens
  misc_feature (1)..(19): microsequencing oligo for 99-140-130.mis2
catgctcaattgtttacat

SEQ ID NO: 554 - DNA, 19 bp, Homo sapiens
  misc_feature (1)..(19): potential microsequencing oligo for 99-1462-238.mis2
ctgaagcagaaacacagca

SEQ ID NO: 555 - DNA, 23 bp, Homo sapiens
  misc_feature (1)..(23): microsequencing oligo for 99-147-181.mis2
tataaagatttaagtttttcttt

SEQ ID NO: 556 - DNA, 19 bp, Homo sapiens
  misc_feature (1)..(19): microsequencing oligo for 99-1474-156.mis2
ccatatttcttcttgttat

SEQ ID NO: 557 - DNA, 19 bp, Homo sapiens
  misc_feature (1)..(19): potential microsequencing oligo for 99-1474-359.mis2
catctgatattagggaatt

SEQ ID NO: 558 - DNA, 19 bp, Homo sapiens
  misc_feature (1)..(19): potential microsequencing oligo for 99-1479-158.mis2
aatatacactccaattagc

SEQ ID NO: 559 - DNA, 19 bp, Homo sapiens
  misc_feature (1)..(19): potential microsequencing oligo for 99-1479-379.mis2
ctgtaccatgagctgcttc

SEQ ID NO: 560 - DNA, 19 bp, Homo sapiens
  misc_feature (1)..(19): potential microsequencing oligo for 99-148-129.mis2
cagccctatgtattaaatt

SEQ ID NO: 561 - DNA, 19 bp, Homo sapiens
  misc_feature (1)..(19): potential microsequencing oligo for 99-148-132.mis2
ttgcagccctatgtattaa

SEQ ID NO: 562 - DNA, 19 bp, Homo sapiens
  misc_feature (1)..(19): potential microsequencing oligo for 99-148-139.mis2
ccttgttttgcagccctat

SEQ ID NO: 563 - DNA, 19 bp, Homo sapiens
  misc_feature (1)..(19): potential microsequencing oligo for 99-148-140.mis2
accttgttttgcagcccta

SEQ ID NO: 564 - DNA, 23 bp, Homo sapiens
  misc_feature (1)..(23): microsequencing oligo for 99-148-182.mis2
gaatgctttgggaccatccaaca

SEQ ID NO: 565 - DNA, 19 bp, Homo sapiens
  misc_feature (1)..(19): potential microsequencing oligo for 99-148-366.mis2
gaggcggcagccgtgagca

SEQ ID NO: 566 - DNA, 19 bp, Homo sapiens
  misc_feature (1)..(19): potential microsequencing oligo for 99-148-76.mis2
tatgaagccatcaagagta

SEQ ID NO: 567 - DNA, 19 bp, Homo sapiens
  misc_feature (1)..(19): microsequencing oligo for 99-1480-290.mis2
aaaaggatcagtggttgcc

SEQ ID NO: 568 - DNA, 19 bp, Homo sapiens
  misc_feature (1)..(19): microsequencing oligo for 99-1481-285.mis2
taccatcttgaggttagag

SEQ ID NO: 569 - DNA, 19 bp, Homo sapiens
  misc_feature (1)..(19): potential microsequencing oligo for 99-1484-101.mis2
agattttaaggagaggagt

SEQ ID NO: 570 - DNA, 19 bp, Homo sapiens
  misc_feature (1)..(19): potential microsequencing oligo for 99-1484-328.mis2
tctgaaaactgaatccctt

SEQ ID NO: 571 - DNA, 19 bp, Homo sapiens
  misc_feature (1)..(19): microsequencing oligo for 99-1485-251.mis2
aggggacattcttggttct

SEQ ID NO: 572 - DNA, 19 bp, Homo sapiens
  misc_feature (1)..(19): potential microsequencing oligo for 99-1490-381.mis2
agatgcacagtagcgtacc

SEQ ID NO: 573 - DNA, 19 bp, Homo sapiens
  misc_feature (1)..(19): microsequencing oligo for 99-1493-280.mis2
acaagcagccaaaccccat

SEQ ID NO: 574 - DNA, 23 bp, Homo sapiens
  misc_feature (1)..(23): microsequencing oligo for 99-151-94.mis2
atatagattttgaaattttagaa

SEQ ID NO: 575 - DNA, 19 bp, Homo sapiens
  misc_feature (1)..(19): potential microsequencing oligo for 99-211-291.mis2
cattgacctgttgaaaaca

SEQ ID NO: 576 - DNA, 19 bp, Homo sapiens
  misc_feature (1)..(19): potential microsequencing oligo for 99-213-37.mis2
tcagacactggagtcctcc

SEQ ID NO: 577 - DNA, 19 bp, Homo sapiens
  misc_feature (1)..(19): potential microsequencing oligo for 99-221-442.mis2
gtctggctaggtcatggaa

SEQ ID NO: 578 - DNA, 19 bp, Homo sapiens
  misc_feature (1)..(19): potential microsequencing oligo for 99-222-109.mis2
ctgaagaaattcatatcgt

What is claimed is:

1. An isolated, purified, or recombinant polynucleotide comprising SEQ ID NO: 179.

2. A recombinant, purified or isolated polynucleotide comprising a contiguous span of 40, 50, 60, 70, 80, 90, 100, 150, 200, 500 or 1000 nucleotides of SEQ ID NO: 179, wherein said contiguous span comprises at least 1 of the following nucleotide positions: 3456–3572 or 5028–6086.

3. A probe consisting of a contiguous span of nucleotides selected from the group consisting of nucleotide sequences spanning from position N–X to position N+Y of SEQ ID NO:179, or consisting of a contiguous span of nucleotides that is complementary to said contiguous span of nucleotides selected from a group of nucleotide sequences spanning from position N–X to position N+Y of SEQ ID NO:179, wherein:

i) X is equal to 8, 10, 12, 15, 20, 25, or a range of 8 to 30;
ii) Y is equal to 8, 10, 12, 15, 20, 25, or a range of 8 to 30; and
iii) N is equal to one of the following values: 2159; 2443; 4452; 5733; 8438; 11843; 1983; 12080; 12221; 12947; 13147; 13194; 13310; 13342; 13367; 13594; 13680; 13902; 16231; 16388; 17608; 18034; 18290; 18786; 22835; 22872; 25183; 25192; 25614; 26911; 32703; 34491; 34756; 34934; 35160; 39897; 40598; 40816; 40947; 45783; 47929; 48206; 48207; 49282; 50037; 50054; 50101; 50220; 50440; 50562; 50653; 50660; 50745; 50885; 51249; 53272; 53389; 53511; 53600; 53665; 53815; 54365; or 54541.

4. A primer consisting of a contiguous span of nucleotides selected from the group consisting of nucleotide sequences spanning from position N–X to position N–1 of SEQ ID NO:179, or consisting of a contiguous span of nucleotides that is complementary to said contiguous span of nucleotides selected from a group of nucleotide sequences spanning from position N–X to position N–1 of SEQ ID NO:179, wherein:

i) X is equal to 15, 18, 20, 25, 30, or a range of 15 to 30; and
ii) N is equal to one of the following values: 2159; 2443; 4452; 5733; 8438; 11843; 1983; 12080; 12221; 12947; 13147; 13194; 13310; 13342; 13367; 13594; 13680; 13902; 16231; 16388; 17608; 18034; 18290; 18786; 22835; 22872; 25183; 25192; 25614; 26911; 32703; 34491; 34756; 34934; 35160; 39897; 40598; 40816; 40947; 45783; 47929; 48206; 48207; 49282; 50037; 50054; 50101; 50220; 50440; 50562; 50653; 50660; 50745; 50885; 51249; 53272; 53389; 53511; 53600; 53665; 53815; 54365; or 54541.

* * * * *

UNITED STATES PATENT AND TRADEMARK OFFICE
CERTIFICATE OF CORRECTION

PATENT NO. : 7,189,833 B2  
APPLICATION NO. : 09/901484  
DATED : March 13, 2007  
INVENTOR(S) : Daniel Cohen et al.

Page 1 of 2

It is certified that error appears in the above-identified patent and that said Letters Patent is hereby corrected as shown below:

Column 19,
Line 12, "The tern" should read --The term--.
Line 53, "and 35" should read --and 315--.

Column 22,
Line 22, "Washburn et al." should read --Washbum et al.--.
Lines 24-25, "(Washburn" should read --(Washbum--.

Column 29,
Line 28, "5 MM MgCl$_2$" should read --5 mM MgCl$_2$--.

Column 30,
Line 25, "72° C. final elongation" should read --72° C. For final elongation--.

Column 31,
Line 45, "The re was incubated" should read --The reaction product was incubated--.

Column 47,
Line 14, "Tumor Supressor" should read --Tumor Suppressor--.

Column 51,
Line 10, "44-187" should read -- 4-4-187--.
Line 12, "442-304" should read -- 4-42-304--.
Line 13, "443-328" should read -- 4-43-328--.
Line 28, "SEQ I) NOs 464" should read --SEQ ID NOs 464--.
Line 54, "99-221442 of" should read --99-221-442 of--.

Column 82,
Line 37, "by loxp sites" should read --by loxP sites--.

Column 84,
Line 6, "(Bemoist" should read --(Bernoist--.

Column 85,
Line 4, "(Stemberg N. L., 1994" should read --(Sternberg N.L., 1994--.

Column 89,
Line 56, "the loxp sites" should read --the loxP sites--.

UNITED STATES PATENT AND TRADEMARK OFFICE
CERTIFICATE OF CORRECTION

PATENT NO. : 7,189,833 B2
APPLICATION NO. : 09/901484
DATED : March 13, 2007
INVENTOR(S) : Daniel Cohen et al.

It is certified that error appears in the above-identified patent and that said Letters Patent is hereby corrected as shown below:

Column 101,
Lines 59-60, "with 0-phenylenediamine" should read --with $o$-phenylenediamine--.

Column 123,
Line 9, "nucteic acid" should read --nucleic acid--.

Signed and Sealed this

Eighteenth Day of December, 2007

JON W. DUDAS
*Director of the United States Patent and Trademark Office*